(12) United States Patent
Kelly et al.

(10) Patent No.: US 9,580,705 B2
(45) Date of Patent: Feb. 28, 2017

(54) DHAD VARIANTS AND METHODS OF SCREENING

(71) Applicant: BUTAMAX ADVANCED BIOFUELS LLC, Wilmington, DE (US)

(72) Inventors: Kristen J. Kelly, Wilmington, DE (US); Rick W. Ye, Hockessin, DE (US)

(73) Assignee: Butamax Advanced Biofuels LLC, Wilmington, DE (US)

(*) Notice: Subject to any disclaimer, the term of this patent is extended or adjusted under 35 U.S.C. 154(b) by 52 days.

(21) Appl. No.: 14/207,823

(22) Filed: Mar. 13, 2014

(65) Prior Publication Data

US 2014/0273116 A1  Sep. 18, 2014

Related U.S. Application Data

(60) Provisional application No. 61/789,204, filed on Mar. 15, 2013.

(51) Int. Cl.
| | | |
|---|---|---|
| *C12P 7/16* | (2006.01) | |
| *C12N 9/88* | (2006.01) | |
| *C12P 7/40* | (2006.01) | |
| *C12N 15/52* | (2006.01) | |

(52) U.S. Cl.
CPC .............. *C12N 9/88* (2013.01); *C12N 15/52* (2013.01); *C12P 7/16* (2013.01); *C12P 7/40* (2013.01); *C12Y 402/01009* (2013.01); *Y02E 50/10* (2013.01); *Y02P 20/52* (2015.11)

(58) Field of Classification Search
CPC .......................... C12P 7/16; C12Y 402/01009
See application file for complete search history.

(56) References Cited

U.S. PATENT DOCUMENTS

| | | | |
|---|---|---|---|
| 4,683,202 A | 7/1987 | Mullis | |
| 5,643,779 A | 7/1997 | Erlich et al. | |
| 6,177,264 B1 | 1/2001 | Eggeling et al. | |
| 6,699,703 B1 | 3/2004 | Doucette-Stamm et al. | |
| 7,541,173 B2 | 6/2009 | Bramucci et al. | |
| 7,659,104 B2 | 2/2010 | Bramucci et al. | |
| 7,851,188 B2 | 12/2010 | Donaldson et al. | |
| 7,910,342 B2 | 3/2011 | Liao et al. | |
| 7,932,063 B2 | 4/2011 | Dunson et al. | |
| 7,993,889 B1 | 8/2011 | Donaldson et al. | |
| 8,017,364 B2 | 9/2011 | Bramucci et al. | |
| 8,017,376 B2 | 9/2011 | Dundon et al. | |
| 8,071,358 B1 | 12/2011 | Dundon et al. | |
| 8,129,162 B2 | 3/2012 | Li et al. | |
| 8,178,328 B2 | 5/2012 | Donaldson et al. | |
| 8,188,250 B2 | 5/2012 | Bramucci et al. | |
| 8,206,970 B2 | 6/2012 | Eliot et al. | |
| 8,222,017 B2 | 7/2012 | Li et al. | |
| 8,232,089 B2 | 7/2012 | Urano et al. | |
| 8,241,878 B2 | 8/2012 | Anthony et al. | |
| 8,273,558 B2 | 9/2012 | Donaldson et al. | |
| 8,273,565 B2 | 9/2012 | Dundon et al. | |
| 8,283,144 B2 | 10/2012 | Donaldson et al. | |
| 8,372,612 B2 | 2/2013 | Larossa et al. | |
| 8,389,252 B2 | 3/2013 | Larossa | |
| 8,455,224 B2 | 6/2013 | Paul | |
| 8,455,225 B2 | 6/2013 | Bramucci et al. | |
| 8,465,964 B2 | 6/2013 | Anthony et al. | |
| 8,518,678 B2 | 8/2013 | Flint et al. | |
| 8,557,562 B2 | 10/2013 | Bramucci et al. | |
| 8,614,085 B2 | 12/2013 | Van Dyk et al. | |
| 8,617,861 B2 | 12/2013 | Grady et al. | |
| 8,637,281 B2 | 1/2014 | Paul et al. | |
| 8,637,289 B2 | 1/2014 | Anthony et al. | |
| 8,652,823 B2 | 2/2014 | Flint et al. | |
| 8,669,094 B2 | 3/2014 | Anthony et al. | |
| 8,691,540 B2 | 4/2014 | Bramucci et al. | |
| 8,735,114 B2 | 5/2014 | Donaldson et al. | |
| 8,765,433 B2 | 7/2014 | Gude et al. | |
| 8,785,166 B2 | 7/2014 | Anthony et al. | |
| 8,795,992 B2 | 8/2014 | Bramucci et al. | |
| 8,828,694 B2 | 9/2014 | Anthony et al. | |
| 8,828,695 B2 | 9/2014 | Grady et al. | |
| 8,828,704 B2 | 9/2014 | Donaldson et al. | |
| 8,871,488 B2 | 10/2014 | Dauner et al. | |
| 8,889,385 B2 | 11/2014 | Donaldson et al. | |
| 8,895,307 B2 | 11/2014 | Li et al. | |
| 8,906,666 B2 | 12/2014 | Alsaker | |
| 8,911,981 B2 | 12/2014 | Li et al. | |

(Continued)

FOREIGN PATENT DOCUMENTS

| | | |
|---|---|---|
| CA | 2716427 | 8/2009 |
| EP | 1887081 | 2/2008 |

(Continued)

OTHER PUBLICATIONS

Arthur, et al., Contribution of VanY D,D-Carboxypeptidase to Glycopeptide Resistance in Enterococcus faecalis by Hydrolysis of Peptidoglycan Precursors, Antimicrob. Agents Chemother. 38:1899-1903, 1994.

Wycoff, et al., Characterization and sequence analysis of a stable cryptic plasmid from Enterococcus faecium 226 and development of a stable cloning vector, Appl. Environ. Microbiol. 62:1481-1486, 1996.

Zirkle, et al., Analysis of a 108-kb region of the Saccharopolyspora spinosa genome covering the obscurin polyketide synthase locus, DNA Sequence 15:123-134, 2004.

Dickinson, et al., An investigation of the metabolims of valine to isobutyl alcohol in *Saccharomyces cerevisiae*, J. Biol. Chem. 273: 25751-25756,1998.

(Continued)

*Primary Examiner* — Kagnew H Gebreyesus

(57) ABSTRACT

Methods of screening for dihydroxy-acid dehydratase (DHAD) variants that display increased DHAD activity are disclosed, along with DHAD variants identified by these methods. Such enzymes can result in increased production of compounds from DHAD requiring biosynthetic pathways. Also disclosed are isolated nucleic acids encoding the DHAD variants, recombinant host cells comprising the isolated nucleic acid molecules, and methods of producing butanol.

6 Claims, 3 Drawing Sheets

(56) References Cited

U.S. PATENT DOCUMENTS

| | | |
|---|---|---|
| 8,940,511 B2 | 1/2015 | Larossa |
| 8,945,859 B2 | 2/2015 | Donaldson et al. |
| 8,945,899 B2 | 2/2015 | Li et al. |
| 8,951,774 B2 | 2/2015 | Donaldson et al. |
| 8,951,937 B2 | 2/2015 | Flint et al. |
| 8,956,850 B2 | 2/2015 | Anthony et al. |
| 8,962,298 B2 | 2/2015 | Donaldson et al. |
| 8,969,055 B2 | 3/2015 | Grady et al. |
| 8,969,065 B2 | 3/2015 | Anthony et al. |
| 8,980,612 B2 | 3/2015 | Donaldson et al. |
| 2003/0166179 A1 | 9/2003 | Rajgarhia et al. |
| 2007/0031918 A1 | 2/2007 | Dunson et al. |
| 2008/0182308 A1 | 7/2008 | Donaldson et al. |
| 2008/0293125 A1 | 11/2008 | Subbian et al. |
| 2009/0081746 A1 | 3/2009 | Liao et al. |
| 2010/0081154 A1 | 4/2010 | Flint et al. |
| 2010/0081179 A1 | 4/2010 | Anthony et al. |
| 2010/0081182 A1 | 4/2010 | Paul et al. |
| 2010/0093020 A1 | 4/2010 | Bramucci et al. |
| 2010/0120105 A1 | 5/2010 | Anthony et al. |
| 2010/0221802 A1 | 9/2010 | Grady et al. |
| 2011/0039327 A1 | 2/2011 | Winkler et al. |
| 2011/0076733 A1 | 3/2011 | Urano et al. |
| 2011/0124060 A1 | 5/2011 | Anthony et al. |
| 2011/0136192 A1 | 6/2011 | Paul et al. |
| 2011/0136193 A1 | 6/2011 | Grady et al. |
| 2011/0195505 A1 | 8/2011 | Euler et al. |
| 2011/0244536 A1 | 10/2011 | Nagarajan et al. |
| 2011/0250610 A1 | 10/2011 | Bramucci et al. |
| 2011/0287500 A1 | 11/2011 | Urano et al. |
| 2011/0294179 A1 | 12/2011 | Grady et al. |
| 2012/0034666 A1 | 2/2012 | Hawkins et al. |
| 2012/0058541 A1 | 3/2012 | Alsaker et al. |
| 2012/0064561 A1 | 3/2012 | Flint et al. |
| 2012/0149080 A1 | 6/2012 | Bramucci et al. |
| 2012/0196341 A1 | 8/2012 | Donaldson et al. |
| 2012/0237988 A1 | 9/2012 | Anthony et al. |
| 2012/0258873 A1 | 10/2012 | Gibson et al. |
| 2013/0035515 A1 | 2/2013 | Dobson et al. |
| 2013/0071898 A1 | 3/2013 | Anthony et al. |
| 2013/0171706 A1 | 7/2013 | Donaldson et al. |
| 2013/0203138 A1 | 8/2013 | McElvain et al. |
| 2013/0252296 A1 | 9/2013 | Maggio-Hall et al. |
| 2013/0316414 A1 | 11/2013 | Paul et al. |
| 2014/0004526 A1 | 1/2014 | Dauner et al. |
| 2014/0030782 A1 | 1/2014 | Anthony et al. |
| 2014/0030783 A1 | 1/2014 | Anthony et al. |
| 2014/0038263 A1 | 2/2014 | Flint et al. |
| 2014/0038268 A1 | 2/2014 | Flint et al. |
| 2014/0051133 A1 | 2/2014 | Govindarajan et al. |
| 2014/0051137 A1 | 2/2014 | Flint et al. |
| 2014/0057329 A1 | 2/2014 | Li et al. |
| 2014/0093930 A1 | 4/2014 | Li et al. |
| 2014/0096439 A1 | 4/2014 | Bramucci et al. |
| 2014/0141479 A1 | 5/2014 | Anthony et al. |
| 2014/0170732 A1 | 6/2014 | Bramucci et al. |
| 2014/0186910 A1 | 7/2014 | Rothman et al. |
| 2014/0186911 A1 | 7/2014 | Anthony et al. |
| 2014/0273129 A1 | 9/2014 | Bhalla et al. |
| 2014/0303735 A1 | 10/2014 | Anthony et al. |
| 2014/0335582 A1 | 11/2014 | Donaldson et al. |
| 2014/0349349 A1 | 11/2014 | Dauner et al. |
| 2014/0377824 A1 | 12/2014 | Satagopan et al. |
| 2015/0037855 A1 | 2/2015 | Bhadra et al. |
| 2015/0111269 A1 | 4/2015 | Li et al. |
| 2015/0119608 A1 | 4/2015 | Donaldson et al. |
| 2015/0125920 A1 | 5/2015 | Anthony et al. |

FOREIGN PATENT DOCUMENTS

| | | |
|---|---|---|
| WO | WO2006059111 | 6/2006 |
| WO | WO2007020992 | 2/2007 |
| WO | WO2007106524 | 9/2007 |
| WO | WO2008098227 | 8/2008 |
| WO | WO2009086423 | 7/2009 |
| WO | WO2009149270 | 12/2009 |
| WO | WO2010037111 | 4/2010 |
| WO | WO2010037112 | 4/2010 |
| WO | WO2011019894 | 2/2011 |
| WO | WO2011066356 | 6/2011 |
| WO | WO2011103300 | 8/2011 |
| WO | WO2012071121 | 5/2012 |

OTHER PUBLICATIONS

Durre, New insights and novel developments in clostridal acetone/butanol/isopropanol fermentation, Appl. Microbial. Biotechnol. 49:639-648, 1998.

Eden, et al., Involvement of branched-chain amino acid aminotransferases in the production of fusel alcohols during fermentation in yeast, Appl. Microbiol. Biotechnol. 55:296-300, 2001.

Eichenbaum, et al., Use of the Lactococcal nisA promoter to regulate gene expression in gram-positive bacteria: comparison of induction level and promoter strength Appl. Environ. Microbiol. 64:2763-2769, 1998.

Flint, et al., Dihydroxy acid dehydratase from spinach contains a [2Fe—2S] cluster, J Biol. Chem. 263:3558-3564, 1988.

Flint, et al., Studies on the active site of dihydroxy-acid dehydratase, Bioorganic Chem. 21:367-385, 1993.

Flint, et al., The Inactivation of Fe—S Cluster Containing Hydrolyases by Superoxide, J. Biol. Chem. 268:22369-22376, 1993.

Fujimoto, et al., pAM401-Based Shuttle Vectors That Enable Overexpression of Promoterless Genes and One-Step Purification of Tag Fusion Proteins Directly from Enterococcus faecalis, Appl. Environ. Microbiol. 67:1262-1267, 2001.

Godon, et al., Branched-chain amino acid biosynthesis genes in *Lactococcus lactis* subsp. *lactis*, J. Bacterial. 174:6580-6589, 1992.

Gossens, et al., Control of diacetyl formation by the intensification of the anabolic flux of acetohydroxyacid intermediates, European Brewery Convention: Proceedings of the 21st Congress, Madrid, 1987, pp. 553-560.

Groot, et at.,Technologies for butanol recovery integrated with fermentations, Process. Biochem. 27:61-75, 1992.

Horton, et al., Engineering hybrid genes without the use of restriction enzymes: gene splicing by overlap extension, Gene 77:61-68, 1989.

Imlay, Iron-sulphur clusters and the problem with oxygen, Mol. Microbial. 59:1073-1082, 2006.

Kim, et al., Catalytic promiscuity in dihydroxy-acid dehydratase from the thermoacidophilic archaean Sulfotobus solfataricus, J. Biochem. 139: 591-596, 2006.

Kleerbezem, et al., Controlled Gene Expression Systems for Lactic Acid Bacteria: Transferable Nisin-Inducible Expression Cassettes for *Lactococcus, Leuconostoc,* and *Lactobacillus* spp. Appl. Environ. Microbiol. 63:4581-4584, 1997.

Maguin, et al., New thermosensitive plasmid for gram-positive bacteria, J. Bacteriol. 174:5633-5638, 1992.

Methods in Yeast Genetics, 2005, Cold Spring Harbor Laboratory Press, Cold Spring Harbor, NY, pp. 201-202.

O'Sullivan, et al., High- and low-copy-number Lactococcus shuttle cloning vectors with features for clone screening, Gene 137:227-231, 1993.

Polaina, Cloning of the IL V2, IL V3 and IL V 5 Genes of *Saccharomyces cerevisiae*, Carlsberg Res. Commun., 49:577-584, 1984.

Renault, et al., Plasmid vectors for gram-positive bacteria switching from high to low copy number, Gene 183:175-182, 1996.

Rud, et al., A synthetic promoter library for constitutive gene expression in Lactobacillus plantarum, Microbiology 152:1011-1019, 2006.

Rupp, et al., Electron spin relaxation of iron-sulfur proteins studied by microwave power saturation, Biochim. Biophys. Acta 537:255-269, 1978.

Scott, et al., Sequences of versatile broad-host-range vectors of the RK2 family, Plasmid 50:74-79, 2003.

Seffernick, et al., Melamine deaminase and atrazine chlorohydrolase: 98 percent identical but functionally different, J. Bacterial. 183:2405-2410, 2001.

(56) References Cited

OTHER PUBLICATIONS

Sorvig, et al., Plasmid p256 from Lactobacillus plantarum represents a new type of replicon in lactic acid bacteria, and contains a toxin-antitoxin-like plasmid maintenance system, Microbiology 151:421-431, 2005.
Tanimoto, et al., Analysis of the Conjugal Transfer System of the Pheromone-Independent Highly Transferable Enterococcus Plasmid pMG1: Identification of a tra Gene (traA) Up-Regulated during Conjugation, J. Bacteriol. 184:5800-5804, 2002.
Thompson, et al., CLUSTAL W: improving the sensitivity of progressive multiple sequence alignment through sequence weighting, position-specific gap penalties and weight matrix choice, Nucleic Acids Research 22:4673-4680, 1994.
van Kranenburg, et al., Functional Analysis of Three Plasmids from Lactobacillus plantarum, Appl. Environ. Microbiol. 71:1223-1230, 2005.
Villa, et al., Control of Vicinal Diketone Production by Brewers Yeast, I. Effects of ilv5 and IL V3 Gene Amplification on Vicinal Diketone Production and IL V Enzyme Activity, Journal of the American Society of Brewing Chemists, 53:49-53, 1995.
Watanabe, et al., Identification and characterization of L-Arabonate dehydratase, L-2-keto-3-deoxyarabonate dehydratase, and L-Arabinolactonase involved in an alternative pathway of L-Arabinose metabolism, J. Biol. Chem. 281:33521-3353, 2006.
Branden, et al., Introduction to Protein Structure, Garland Publishing Inc., New York p. 247, 1991.
Gellissen, et al., Heterologous protein production in yeast, Antonie van Leeuwenhoek 62:79-93, 1992.
Harashima, et al., Heterologous Protein Production by Yeast Host-Vector Systems, Biopress technol. 19:137-158, 1994.
Mendoza-Vega, et al., Industrial production of heterologous proteins by fed-batch cultures of the yeast *Saccharomyces cerevisiae*, FEMS Microbiol. Rev. 15:369-410, 1994.
Roggenkamp, et al., Expression and processing of bacterial ß-lactamase in the yeast *Saccharomyces cerevisiae*, Proc. Natl. Acad. Sci. USA 78:4466-4470, 1981.
Romanos, et al., Foreign Gene Expression in Yeast: a Review, Yeast 8: 423-488, 1992.
Russell, et al., Production of Recombinant Products in Yeast: A Review, Australian J. Biotechol. 5:48-55, 1991.
Chica, et al., Semi-rational approaches to engineering enzyme activity: combining the benefits of directed evolution and rational design, Curr. Opin. Biotechnol. 16:378-384, 2005.
Johnson, et al., Structure, Function, and Formation of Biological Iron-Sulfur Clusters, Ann. Rev. Biochem. 74:247-281, 2005.
Chen, et al., Role of NifS in maturation of glutamine phosphoribosylpyrophosphate amidotransferase, J. Bacteriol. 179:7587-7590, 1997.
Flint, *Escherichia coli* Contains a Protein That is Homologous in Function and N-terminal Sequence to the Protein Encoded by the nifS Gene of Azotobacter vinelandii and That can Participate in the Synthesis of the Fe—S Cluster of Dihydroxy-acid Dehydratase, J. Biol. Chem. 271:16068-16074, 1996.
Ui, et al., Production of L-2,3-butanediol by a new pathway constructed in *Escherichia coli*, Lett. Appl. Microbiol. 39:533-537, 2004.
Karlin, et al., Comparative analysis of gene expression among low G+C gram-positive genomes, Proc. Natl. Acad. Sci USA 101:6182-6187, 2004.
Henriksen, et al., Redirection of pyruvate catabolism in Lactococcus lactis by selection of mutants with additional growth requirements, Appl. Microbiol. Biotechnol. 56:767-775, 2001.
Neves, et al., Metabolic characterization of Lactococcus lactis deficient in lactate dehydrogenase using in vivo 13CNMR, Eur. J. Biochem. 267:3859-3868, 2000.
Chen, Ph.D. Thesis, McGill University, Montreal, Canada, Formation and Analysis of Fusel Alcohols in Beer, 1978.
Broun, et al., Catalytic Plasticity of Fatty Acid Modification Enzymes Underlying Chemical Diversity of Plant Lipids, Science 282:1315-1317, 1998.

Devos, et al. Practical Limits of Function Prediction, Proteins: Structure, Function and Genetics 41:98-107, 2000.
Kisselev, Polypeptide Release Factors in Prokaryotes and Eukaryotes: Same Function, Different Structure, Structure 10:8-9, 2002.
Madera, et al., A comparison of profile hidden Markov model procedures for remote homology detection, Nuc. Acids Res. 30:4321-4328, 2002.
Sen, et al. Developments in Directed Evolution for Improving Enzyme Functions, Appl. Biochem. Biotechnol. 143:212-223, 2007.
Stanke, et al., Gene prediction with hidden Markov model and a new intron submodel, Bioinformatics 19 Suppl.2: 215-225, 2003.
Whisstock, et al., Prediction of protein function from protein sequence and structure, Quarterly Reviews of Biophysics 36:307-340, 2003.
Wishart, et al., A Single Mutation Converts a Novel Phosphotyrosine Binding Domain into a Dual-specificity Phosphate, J. Biol. Chem. 270:26782-26785, 1995.
Witkowski, et al., Conversion of a beta-Ketoacyl Synthase to Malonyl Decarboxylase by Replacement of the Active-Site Cysteine with Glutamine, Biochem. 38:11643-11650, 1999.
Chen, et al., Inhibition of Fe—S cluster biosynthesis decreases mitochondrial iron export: Evidence that Yfh1p affects Fe—S cluster synthesis, Proc. Natl. Acad. Sci. 99:12321-12326, 2002.
Jensen, et al., Role of *Saccharomyces cerevisiae* ISA1 and ISA2 in Iron Homeostasis, Mol. Cell Biol. 20:3918-3927, 2000.
Nakamura, et al., Hyperproduction of Recombinant Ferredoxins in *Escherichia coli* by Coexpression of the ORF1-ORF2-iscS-iscU-iscA-hscB-hscA-fdx-ORF3 Gene Cluster, J. Biochem. 126:10-18, 1999.
Garland, et al., *Saccharomyces cerevisiae* ISU1 and ISU2: Members of a Well-conserved Gene Family for Iron-Sulfur Cluster Assembly, J. Mol. Biol. 294:897-907,1999.
Altschul, et al., Basic Local Alignment Search Tool, J. Mol. Biol. 215:403-410, 1990.
Flint, et al., The role and properties of the iron-sulfur cluster in *Escherichia coli* dihydroxy-acid dehydratase. J. Biol. Chem. 268:14732-14742, 1993.
Deshpande, et al., Ethanol Production from Cellulose by Coupled Saccharification/Fermentation using *Saccharomyces cerevisiae* and Cellulase Complex from Sclerotium rolfsii UV-8 Mutant, Appl. Biochem. Biotechnol. 36:227-234, 1992.
Frohman, et al., Rapid production of full-length cDNAs from rare transcripts: Amplification using a single gene-specific oligonucleotide primer, Proc. Natl. Acad. Sci. 85:8998-9002, 1988.
Guo, et al., Pervaporation study on the dehydration of aqueous butanol solution: a comparison of flux vs. permeance, separation factor vs. selectivity, J. Membrane Sci. 245:199-210, 2004.
Hartmanis, et al., Diol Metabolism and Diol Dehydratase in Clostridium glycolicum, Arch. Biochem. Biophys. 245:144-152, 1986.
Higgins, et al., Fast and sensitive multiple sequence alignments on a microcomputer, CABIOS Communications 5:151-153, 1989.
Higgins, et al., CLUSTAL V: improved software for multiple sequence alignment, CABIOS 8:189-191, 1992.
Krogh, et al., Hidden Markov Models in Computational Biology, J. Mol. Biol. 235:1501-1531, 1994.
Loh, et al., Polymerase Chain Reaction with Single-Sided Specificity: Analysis of T Cell Receptor Gamma Chain, Science 243:217-220, 1989.
Mnaimneh, et al., Exploration of Essential Gene Functions via Titratable Promoter Alleles, Cell 118:31-44, 2004.
O'Brien, et al., Insight into the Mechanism of the B12-Independent Glycerol Dehydratase from Clostridium butyricum: Preliminary Biochemical and Structural Characterization, Biochemistry 43:4635-4645, 2004.
O'Hara, et al. One-sided polymerase chain reaction: The amplification of cDNA, Proc. Natl. Acad. Sci. 36:5673-5677, 1989.
Scott, et al., Whole-Genome Transcription Profiling Reveals Genes Up-Regulated by Growth on Fucose in the Human Gut Bacterium "*Roseburia inulinivorans*," J. Bacteriol. 188:4340-4349, 2006.

(56) References Cited

OTHER PUBLICATIONS

Sulter, et al., Proliferation and metabolic significance of peroxisomes in Candida boidinii during growth on o-alanine or oleic acid as the sole carbon source, Arch. Microbiol. 153:485-489, 1990.
Tabor et al., A bacteriophage T7 RNA polymerase/promoter system for controlled exclusive expression of specific genes, Proc. Natl. Acad. Sci. 82:1074-1078, 1985.
Van Ness, et al., The use of oligodeoxynucleotide probes in chaotrope-based hybridization solutions, Nucl. Acid Res. 19:5143-5151, 1991.
Wach, et al., New Heterologous Modules for Classical or PCR-based Gene Disruptions in *Saccharomyces cerevisiae*, Yeast 10:1793-1808, 1994.
Walker, et al., Isothermal in vitro amplification of DNA by a restriction enzyme/DNA polymerase system, Proc. Natl. Acad. Sci. 89:392-396, 1992.
Aden, et al. Lignocellulosic Biomass to Ethanol Process Design and Economics Utilizing Co-Current Dilute Acid Prehydrolysis and Enzymatic Hydrolysis for Corn Stover, Report NREL/TP-510-32438, National Renewable Energy Laboratory, Jun. 2002.
Flint, et al., The Inactivation of Dihydroxy-acid Dehydratase in *Escherichia coli* Treated with Hyperbaric Oxygen Occurs Because of the Destruction of its Fe—S Cluster, but the Enzyme Remains in the Cell in a FormThat Can Be Reactivated, J. Biol. Chem. 268:25547-25552, 1993.
Bellion, et al., Microb. Growth C1 Compd., [Int. Symp.], 7th (1993), 415 32. Editor(s): Murrell, J. Collin; Kelly, Don P. Publisher: Intercept, Andover, UK.
Connor, et al., Engineering of an *Escherichia coli* Strain for the Production of 3-Methyl-1-Butanol, Appl. Environ. Microbiol. 74:5769-5775, 2008.
Malkin, et al., The Reconstitution of Clostridial Ferredoxin, Biochem. Biophys. Res. Comm. 23:822-827, 1996.
Liu, et al., Electron Paramagnetic Resonance Evidence for a Novel Interconversion of [3Fe—4S] and [4Fe—4S] Clusters with Endogenous Iron and Sulfide in Anaerobic Ribonucleotide Reductase Activase in Vitro, J. Biol. Chem. 275:12367-12373, 2000.
Tokumoto, et al., Genetic analysis of the isc operon in *Escherichia coli* involved in the biogenesis of cellular iron sulfur proteins, J. Biochem. 130:63-71, 2001.
Fontecave, et al., Mechanisms of iron-sulfur cluster assembly; the SUF machinery, J. Biol. Inorganic Chem. 10:713-721, 2005.
Elli, et al., Iron requirement of *Lactobacillus* spp. in completely chemically defined growth media, J. Appl. Microbiol. 88:695-703, 2000.
Hebert, et al., Nutritional Requirements of *Lactobacillus delbrueckii* subsp. *lactis* in a Chemically Defined Medium. Curr. Microbiol. 49:341-345, 2004.
Duhutrel, et al., Iron Sources Used by the Nonpathogenic Lactic Acid Bacterium Lactobacillus sakei as Revealed by Electron Energy Loss Spectroscopy and Secondary-Ion Mass Spectrometry, Appl. Environ. Microbiol. 76:560-565, 2009.
Rychlik, In Methods in Molecular Biology, White, B. A. Ed., (1993) vol. 15, pp. 31 39, PCR Protocols: Current Methods and Applications. Humania: Totowa, NJ.
Sambrook, et al., Molecular Cloning: A Laboratory Manual, 2nd ed., Cold Spring Harbor Laboratory: Cold Spring Harbor, NY (1989).
Imbert, et al., On the Iron Requirement of Lactobacilli Grown in Chemically Defined Medium, Curr. Microbiol. 37:64-66, 1998.
Pandey, et al., Iron requirement and search for siderophores in lactic acid bacteria, Appl. Microbiol. Biotechnol. 40:735-739, 1994.
Archibald, Lactobacillus plantarum, an organism not requiring iron, FEMS Microbiol. Lett. 19:29-32, 1983.
Shrago, et al.,Conjugal Plasmid Transfer (pAMb1) in Lactobacillus plantarum, Appl. Environ. Microbiol. 52:574-576, 1986.

Thein, et al., "The use of oligonucleotides as specific hybridization probes in the Diagnosis of Genetic Disorders," in Human Genetic Diseases: A Practical Approach, K. E. Davis Ed., (1986) pp. 33 50, IRL: Herndon, VA.
Cruz-Rodz, et al., High efficiency introduction of plasmid DNA into glycine treated Enterococcus Faecalis by electroporation, Mol. Gen. Gent. 224:152-154, 1990.
W. R. Pearson, Comput. Methods Genome Res., [Proc. Int. Symp.] (1994), Meeting Date 1992, 111-120.
Velasco, et al., Cloning of the dihydroxyacid dehydratase-encoding gene (ILV3) from *Saccharomyces cerevisiae*, Gene 137:179-185, 1993.
Casey, Cloning and Analysis of Two Alleles of the ILV3 Gene from *Saccharomyces cerevisiae*, Carlsberg Research Communications 51:327-341, 1986.
Guo, et al., Protein tolerance to random amino acid change, Proc. Natl. Acad. Sci. 101:9205-9210, 2004.
Lazar, et al., Transforming Growth Factor alpha: Mutation of Aspartic Acid 47 and Leucine 48 Results in Different Biological Activity Mol. Cell Biol. 8:1247-1252, 1988.
Hill, et al., Functional Analysis of Conserved Histidines in ADP-Glucose Pyrophosphorylase from *Escherichia coli*, Biochem. Biophys. Res. Comm. 244:573-577, 1998.
Wacey, et al., Disentangling the perturbational effects of amino acid substitutions in DNA-binding domin of p53, Human Genetics 104:15-22, 1999.
Goldberg, et al., Localization and functionality of microsporidian iron-sulphur cluster assembly proteins, Nature 452:624-628, 2008.
Flint, et al., Studies on the synthesis of the Fe—S cluster of dihydroxy-acid dehydratase in *Escherichia coli* crude extract, J. Biol. Chem. 271:16053-16067, 1996.
Bandyopadhyay, et al., A Proposed Role for the Azotobacter vinelandii NfuA Protein as an Intermediate Iron-Sufur Cluster Carrier, J. Biol. Chem. 283:14092-14099, 2008.
Foury, et al., Mitochondrial Control of Iron Homeostasis, J. Biol. Chem. 276:7762-7768, 2001.
Gerber, et al., The Yeast Scaffold Proteins Isu1p and Isu2p are Required Inside Mitochondria for Maturation of Cytosolic Fe/S Proteins, Mol. Cell. Biol. 24:4848-4857, 2004.
Gupta, et al., Native *Escherichia coli* SufA, Coexpressed with SufBCDSE, Purifies as a [2Fe—2S] Protein and Acts as an Fe—S Transporter to Fe—S Target Enzymes, J. Am. Chem. Soc. 131:6149-6153, 2009.
Kaplan, et al., Iron Acquisition and Transcriptional Regulation, Chem. Rev. 109:4536-4552, 2009.
Kim, et al., Transposable Elements and Genome Organization: A Comprehensive Survey of Retrotransposons Revealed by the Complete *Saccharomyces cervisiae* Genome Sequence, Genome Res. 8:464-478, 1998.
Kumanovics, et al., Identification of FRA1 and FRA2 as Genes Involved in Regulatng the Yeast Iron Regulon in Response to Decreased Mitochondrial Iron-Sulfur Cluster Synthesis, J. Biol. Chem. 283:10276-10286, 2008.
Li, et al., The Yeast Iron Regulatory Proteins Grx3/4 and Fra2 Form Heterodimeric Complexes Containing a [2Fe—2S] Cluster with Cysteinyl and Histidyl Ligation, Biochemistry 48:9569-9581, 2009.
Li, et al., CCC1 is a Transporter That Mediates Vacuolar Iron Storage in Yeast, J. Biol. Chem. 276:29515-29519, 2001.
Liu, et al., Iron-Sulfur Cluster Biosynthesis: Functional Characterization of the N- and C-Terminal Domains of Human NFU, Biochemistry 48:973-980, 2009.
Nakamura, et al., Codon usage tabulated from international DNA sequence databases: status for the year 2000, Nuc. Acids Res. 28:292, 2000.
Ojeda, et al., Role of Glutaredoxin-3 and Glutaredoxin-4 in the Iron Regulation of the Aft1 Transcriptional Activator in *Saccharomyces cervisiae*, J. Biol. Chem. 281:17661-17669, 2006.
Pujol-Carrion, et al., Glutaredoxins Grx3 and Grx4 regulate nuclear localisation of Aft1 and the oxidative stress response in *Saccharomyces cerevisiae*, J. Cell Sci. 19:4554-4564, 2006.

(56) References Cited

OTHER PUBLICATIONS

Rutherford, et al., Activation of the Iron Regulation by the Yeast Aft1/Aft2 Tanscription Factors Depends on Mitochondrial but not Cytosolic Iron-Sulfur Protein Biogenesis, J. Biol. Chem. 280:10135-10140, 2005.
Shakoury-Elizeh, et al., Transcriptional Remodeling in Response to Iron Deprivation in *Saccharomyces cerevisiae*, Mol. Biol. Cell 15:1233-1243, 2004.
Ueta, et al., Pse1p Mediates the Nuclear Import of the Iron-responsive Transcription Factor Aft1p in *Saccharomyces cerevisiae*, J. Biol. Chem. 278:50120-50127, 2003.
Yamaguchi-Iwai, et al., Subcellular Localization of Aft1 Transcription Factor Responds to Iron Status in *Saccharomyces cerevisiae*, J. Biol. Chem. 277:18914-18918, 2002.
Yamaguchi-Iwai, et al., AFT1: a mediator of iron regulated transcriptional control in *Saccharomyces cerevisiae*, EMBO J. 14:1231-1239, 1995.
Tan et al., IscA/SufA paralogues are required for the [4Fe—4S] cluster assembly in enzymes of multiple physiological pathways in *Escherichia coli* under aerobic growth conditions, Biochem. J. 420:463-472, 2009.
Lill, et al., Maturation of Iron-Sulfur Proteins in Eukaryotes: Mechanisms, Connected Processes, and Diseases, Ann. Rev. Biochem. 77:669-700, 2008.
Ryan, et al., Subcellular Localization of Isoleucine-Valine Biosynthetic Enzymes in Yeast, J. Bacteriol. 120:631-637, 1974.
Askwith, et al., The FET3 Gene of S. cerevisiae Encodes a Multicopper Oxidase Required for Ferrous Iron Uptake, Cell 76:403-410,1994.
Armstrong, et al., Stereoselectivity and Stereospecificity of the alpha, beta-Dihydroxy Acid Dehydratase from *Salmonella typhimurium*, Biochimica et Biophysica Acta 498:282-293, 1977.
Armstrong, Stereochemistry of the Reductoisomerase and alpha, beta-Dihydroxyacid Dehydratase-catalysed Steps in Valine and Isoleucine Biosynthesis. Observation of a Novel Tertiary Ketol Rearrangement, J.C.S. Chem. Comm. 9:351-352, 1974.
Armstrong, et al., Structure-Activity Studies with the alpha, beta-Dihydroxyacid Dehydratase of *Salmonella typhimurium*, J. Chem. Soc. Perkin Trans. 1:691-696, 1985.
Atsumi, et al., Metabolic engineering for advanced biofuels production from *Escherichia coli*, Curr. Opin. Biotechnol. 19:414-419, 2008.
Casas, et al., The AFTI Tanscriptional Factor is Differentially Required for Expression of High-Affinity Iron Uptake Genes in *Saccharomyces cerevisiae*, Yeast 13:621-637, 1997.
Coleman, et al. Branched-chain Amino-acid Aminotransferase of *Salmonella typhimurium*: I. Crystallization and Preliminary Characterization, Biochimica et Biophysica Acta 227:56-66, 1971.
Conde, et al., KlAft, the Kluyveromyces lactis Ortholog of Aft I and Aft2, Mediates. Activation of Iron-Responsive Transcription Through the PuCACCC Aft-Type Sequence, Genetics 183:93-106, 2009.
Hausmann et al., The eukaryotic P loop NTPase Nbp35: An essential component of the cytosolic and nuclear iron-sulfur protein assembly machinery, Proc. Natl. Acad Sci. 102:3266-3271, 2005.
Holatko, et al., Metabolic engineering of the L-valine biosynthesis pathway in Corynebacterium using glutamicum using promoter activity modulation, J. Biotechnol. 139:203-210, 2009.
Ihrig, et al., Iron Regulation through the Back Door: Iron-Dependent Metabolite Levels Contribute to Transcriptional Adaptation to Iron Deprivation in *Saccharomyces cerevisiae*, Eukaryotic Cell 9:460-471, 2010.
Mercier, et al., Both Php4 Function and Subcellular Localization are Regulated by Iron via a Multistep Mechanism Involving the Gluaredoxin Grx4 and the Exportin Crm 1, J. Biol. Chem. 284:20249-20262, 2009.
Mohlenhoff, et al., Cytosolic Monothiol Glutaredoxins Function in Intracellular Iron Sensing and Trafficking via Their Bound Iron-Sulfur Cluster, Cell Metabolism 12:373-385, 2010.

Ojeda, Iron Sensing in the Model Organism *Saccharomyces cerevisiae*, A dissertation submitted to the faculty of the University of Utah in partial fulfillment of the requirements for the degree of Doctor of Philosophy, The University of Utah, United States (2006).
Puig, et al., Coordinated Remodeling of Cellular Metabolism during Iron Deficiency through Targeted mRNA Degradation, Cell 120:99-110, 2005.
Rutherford, et al., A second iron-regulatory system in yeast independent of Aft1p, Proc. Natl. Acad. Sci. 98 (25):14322-14327, 2001.
Rutherford, et al., Aft1p and Aft2p Mediate Iron-responsive Gene Expression in Yeast through Related Promoter Elements, J. Biol. Chem. 278:27636-27643, 2003.
Seguin, et al., Overexpression of the yeast frataxin homolog (Yfh1): Contrasting effects on iron-sulfur cluster assembly, heme synthesis and resistance to oxidative stress, Mitochondrion 9:130-138, 2009.
Stemmler, et al., Frataxin and Mitochondrial FeS Cluster Biogenesis, J. Biol. Chem. 285:26737-26743, 2010.
Twarog, Enzymes of the Isoleucine-Valine Pathway in Acinetobacter, J. Bacteriol. 111:37-46, 1972.
Wixom, et al., A Rapid Determination of Dihydroxyacid Dehydratase Activity in Microbial Cell Suspensions, Anal. Biochem. 42:262-274, 1971.
Xing, et al., Characterization of Enzymes of the Branched-Chain Amino Acid Biosynthetic Pathway in *Methanococcus* spp., J. Bacteriol. 173:2086-2092, 1991.
Alegre, et al., Transformation of Lactobacillus plantarum by electroporation with in vitro modified plasmid DNA, FEMS Microbiol. Lett., 241:73-77, 2004.
Bringel, et al., Optimized transformation by electroporation of Lactobacillus plantarum strains with plasmid vectors, Appl. Microbiol. Biotechnol. 33:664-670, 1990.
Ferain, et al., Lactobacillus plantarum ldhL gene: Overexpression and Deletion, J. Bact. 176:596, 1994.
Hols, et al., Use of Homologous Expression-Secretion Signals and Vector-Free Stable Chromosomal Integration in Engineering of Lactobacillus plantarum for oL-Amylase and Levanase Expression, Appl. Environ. Microbiol. 60:1401-1403, 1994.
Horinouchi, et al., Nucleotide Sequence and Functional Map of pE194, a Plasmid That Specifies Inducible Resistance to Macrolide, Lincosamide, and Streptogramin Type B Antibiotics, J. Bacteriol. 150:804-814, 1982.
Jang, et al., New integration vector using a cellulase gene as a screening marker for Lactobacillus, Micro. Lett. 24:191-195, 2003.
Hong, et al., Metabolic engineering of *Saccharomyces cerevisiae*: a key cell factory platform for future biorefineries, Cell. Mol. Life Sci. 69:2671-2690, 2012.
GenBank ADA64951, Dihydroxy-acid dehydratase [*Lactococcus lactis* subsp. *lactis* KF147], Jan. 30, 2014.
NCBI Reference Sequence: WP_011676306 (formerly YP_809259) Dihydroxy-acid dehydratase [*Lactococcus lactis* subsp. *cremoris* SK11], Apr. 27, 2015.
GenBank AF508808, Lactobacillus plantarum plasmid pLF1 putative integrase/recombinase, ISLP1 transposase, and cold shock protein genes, complete cds, Jun. 24, 2002.
GenBank ABH11633, Putative ABC transporter ABC5MC5 [Lactobacillus helveticus CNRZ32], Jun. 14, 2007
UniProtKB/Swiss-Prot: Q1WS05, Iron-sulfur cluster assembly/repair protein Lactobacillus salivarius UCC118, Oct. 31, 2006.
UniProt E1TL94, Cysteine desulfurase, Lactobacillus plantarum, Feb. 22, 2012.
UniProt E1TPR8, NifU-like protein, Lactobacillus plantarum Feb. 22, 2012.
NCBI Reference Sequence: NC_004567, Lactobacillus plantarum WCFS1, complete genome, Mar. 25, 2015.
UniProtKB/Swiss-Prot: Q8DRT7, Dihydroxy-acid dehydratase, ILVD_STRUM, *Streptococcus mutans*, Feb. 22, 2012.
Sequence 615 from International Patent Application No. WO 2010/0037112; Apr. 29, 2010.
UniProtKB: J3JBZ2, Dihydroxy-acid dehydratase, *Lactobacillus coryniformis* subsp., Oct. 3, 2012.
UniProtKB/TrEMBL: I4X3T0, Dihydroxy-acid dehydratase, Planococcus antarcticus DSM 14505, Sep. 5, 2012.

(56) References Cited

OTHER PUBLICATIONS

Re-examination of U.S. Pat. No. 8,241,878, U.S. Control No. 95/002,167, filed Sep. 10, 2012.
Re-examination of U.S. Patent No. 8,017,376, U.S. Control No. 95/001,870, filed Jan. 10, 2012.
International Search Report for corresponding International Application No. PCT/US2014/025183, dated Sep. 5, 2014.

US 9,580,705 B2

DHAD VARIANTS AND METHODS OF SCREENING

This application claims the benefit of U.S. Provisional Application No. 61/789,204, filed Mar. 15, 2013; the entire contents of which are herein incorporated by reference.

The content of the electronically submitted sequence listing, filed herewith, is incorporated herein by reference in its entirety.

STATEMENT REGARDING FEDERALLY-SPONSORED RESEARCH AND DEVELOPMENT

This invention was made with Government support under Agreement DE-AR0000006 awarded by the United States Department of Energy. The Government has certain rights in this invention.

FIELD OF THE INVENTION

The present invention relates to the field of industrial microbiology and dihydroxy-acid dehydratase variants for production pathways, including isobutanol biosynthetic pathways, in microorganisms. The invention also provides methods for screening for dihydroxy-acid dehydratase variants with improved characteristics. For example, dihydroxy-acid dehydratase variants are disclosed with increased activity compared to a parental dihydroxy-acid dehydratase.

BACKGROUND

Dihydroxy-acid dehydratase (DHAD), also called acetohydroxy acid dehydratase, catalyzes the conversion of 2,3-dihydroxyisovalerate to α-ketoisovalerate and of 2,3-dihydroxymethylvalerate to α-ketomethylvalerate. The DHAD enzyme, classified by the Enzyme Commission (EC) number 4.2.1.9, is part of the naturally occurring biosynthetic pathways that produce valine, isoleucine, leucine, and pantothenic acid (vitamin B5). DHAD-catalyzed conversion of 2,3-dihydroxyisovalerate to α-ketoisovalerate is also a common step in the multiple isobutanol biosynthetic pathways that are disclosed, for example, in U.S. Pat. No. 7,851,188. Disclosed therein is engineering of recombinant microorganisms for production of isobutanol. Isobutanol is useful as a fuel additive, and the availability of biologically-produced isobutanol can reduce the demand for petrochemical fuels.

SUMMARY OF THE INVENTION

The present invention provides, for example, isolated polypeptides and fragments thereof having dihydroxy-acid dehydratase (DHAD) activity.

One aspect of the invention is directed to an isolated polypeptide or fragment thereof having DHAD activity, wherein the polypeptide or fragment thereof comprises one or more amino acid substitutions selected from: (a) aspartic acid at a position corresponding to position 33 of *Streptococcus mutans* DHAD; (b) glutamic acid at a position corresponding to position 62 of *Streptococcus mutans* DHAD; (c) valine at a position corresponding to position 115 of *Streptococcus mutans* DHAD; (d) glutamic acid at a position corresponding to position 116 of *Streptococcus mutans* DHAD; (e) serine at a position corresponding to position 119 of *Streptococcus mutans* DHAD; (f) arginine at a position corresponding to position 158 of *Streptococcus mutans* DHAD; (g) glutamine at a position corresponding to position 176 of *Streptococcus mutans* DHAD; (h) leucine at a position corresponding to position 179 of *Streptococcus mutans* DHAD; (i) arginine at a position corresponding to position 322 of *Streptococcus mutans* DHAD; (j) serine at a position corresponding to position 425 of *Streptococcus mutans* DHAD; (k) glycine at a position corresponding to position 524 of *Streptococcus mutans* DHAD; (l) valine or leucine at a position corresponding to position 562 of *Streptococcus mutans* DHAD; (m) arginine, cysteine, or glycine at a position corresponding to position 563 of *Streptococcus mutans* DHAD; (n) glutamic acid at a position corresponding to position 564 of *Streptococcus mutans* DHAD; and (o) aspartic acid at a position corresponding to position 567 of *Streptococcus mutans* DHAD.

In an embodiment of the invention, the polypeptide or fragment thereof comprises a substitution of glutamic acid at a position corresponding to position 564 of *Streptococcus mutans* DHAD. In another embodiment, the polypeptide or fragment thereof comprises a substitution of glutamic acid at a position corresponding to position 62 of *Streptococcus mutans* DHAD, and a substitution of valine at a position corresponding to position 562 of *Streptococcus mutans* DHAD. In another embodiment, the polypeptide or fragment thereof comprises a substitution of aspartic acid at a position corresponding to position 33 of *Streptococcus mutans* DHAD, and a substitution of arginine at a position corresponding to position 563 of *Streptococcus mutans* DHAD. In another embodiment, the polypeptide or fragment thereof comprises a substitution of valine at a position corresponding to position 562 of *Streptococcus mutans* DHAD. In another embodiment, the polypeptide or fragment thereof comprises a substitution of arginine at a position corresponding to position 563 of *Streptococcus mutans* DHAD. In another embodiment, the polypeptide or fragment thereof comprises a substitution of cysteine at a position corresponding to position 563 of *Streptococcus mutans* DHAD. In another embodiment, the polypeptide or fragment thereof comprises a substitution of glycine at a position corresponding to position 563 of *Streptococcus mutans* DHAD. In yet another embodiment, the polypeptide or fragment thereof comprises a substitution of glycine at a position corresponding to position 524 of *Streptococcus mutans* DHAD, and a substitution of glycine at a position corresponding to position 563 of *Streptococcus mutans* DHAD.

In an embodiment of the invention, the polypeptide or fragment thereof comprises a substitution of valine at a position corresponding to position 115 of *Streptococcus mutans* DHAD, a substitution of arginine at a position corresponding to position 158 of *Streptococcus mutans* DHAD, and a substitution of aspartic acid at a position corresponding to position 567 of *Streptococcus mutans* DHAD. In another embodiment, the polypeptide or fragment thereof comprises a substitution of glutamic acid at a position corresponding to position 116 of *Streptococcus mutans* DHAD, and a substitution of serine at a position corresponding to position 119 of *Streptococcus mutans* DHAD. In another embodiment, the polypeptide or fragment thereof comprises a substitution of aspartic acid at a position corresponding to position 33 of *Streptococcus mutans* DHAD. In another embodiment, the polypeptide or fragment thereof comprises a substitution of glutamic acid at a position corresponding to position 62 of *Streptococcus mutans* DHAD. In another embodiment, the polypeptide or fragment thereof comprises a substitution of leucine at a position corresponding to position 562 of *Streptococcus mutans* DHAD. In another embodiment, the polypeptide or fragment thereof comprises a substitution of glutamine at a position corresponding to position 176 of *Streptococcus mutans* DHAD, a substitution of leucine at a position corresponding to position 179 of *Streptococcus mutans* DHAD, a substitution of arginine at a position corresponding to position 322 of *Streptococcus mutans* DHAD, and a substitution of arginine at a position corresponding to position 563 of *Streptococcus mutans* DHAD. In yet another embodiment, the polypeptide or fragment thereof comprises a substitution of serine at a position corresponding to position 425 of *Streptococcus mutans* DHAD, and a substitution of arginine at a position corresponding to position 563 of *Streptococcus mutans* DHAD.

In another aspect, the invention is directed to an isolated polypeptide or fragment thereof having dihydroxy-acid dehydratase (DHAD) activity, wherein the polypeptide or fragment thereof comprises one or more amino acid substitutions selected from: (a) glycine to aspartic acid at a position corresponding to position 33 of *Streptococcus mutans* DHAD; (b) aspartic acid to glutamic acid at a position corresponding to position 62 of *Streptococcus mutans* DHAD; (c) methionine to valine at a position corresponding to position 115 of *Streptococcus mutans* DHAD; (d) glycine to glutamic acid at a position corresponding to position 116 of *Streptococcus mutans* DHAD; (e) asparagine to serine at a position corresponding to position 119 of *Streptococcus mutans* DHAD; (f) glycine to arginine at a position corresponding to position 158 of *Streptococcus mutans* DHAD; (g) histidine to glutamine at a position corresponding to position 176 of *Streptococcus mutans* DHAD; (h) histidine to leucine at a position corresponding to position 179 of *Streptococcus mutans* DHAD; (i) glutamine to arginine at a position corresponding to position 322 of *Streptococcus mutans* DHAD; (j) alanine to serine at a position corresponding to position 425 of *Streptococcus mutans* DHAD; (k) glutamic acid to glycine at a position corresponding to position 524 of *Streptococcus mutans* DHAD; (l) phenylalanine to valine or leucine at a position corresponding to position 562 of *Streptococcus mutans* DHAD; (m) tryptophan to arginine, cysteine, or glycine at a position corresponding to position 563 of *Streptococcus mutans* DHAD; (n) lysine to glutamic acid at a position corresponding to position 564 of *Streptococcus mutans* DHAD; and (o) glutamic acid to aspartic acid at a position corresponding to position 567 of *Streptococcus mutans* DHAD.

In another aspect, the invention is directed to an isolated polypeptide or fragment thereof having DHAD activity, wherein the polypeptide or fragment thereof comprises one or more amino acid substitutions selected from: (a) glycine to aspartic acid at position 33; (b) aspartic acid to glutamic acid at position 62; (c) methionine to valine at position 115; (d) glycine to glutamic acid at position 116; (e) asparagine to serine at position 119; (f) glycine to arginine at position 158; (g) histidine to glutamine at position 176; (h) histidine to leucine at position 179; (i) glutamine to arginine at position 322; (j) alanine to serine at position 425; (k) glutamic acid to glycine at position 524; (l) phenylalanine to valine or leucine at position 562; (m) tryptophan to arginine, cysteine, or glycine at position 563; (n) lysine to glutamic acid at position 564; and (o) glutamic acid to aspartic acid at position 567.

In certain embodiments, the isolated polypeptide or fragment thereof having DHAD activity is a $[2Fe-2S]^{2+}$ DHAD. In other embodiments, the isolated polypeptide or fragment thereof having DHAD activity is a $[4Fe-4S]^{2+}$ DHAD. In yet other embodiments, the isolated polypeptide or fragment thereof having DHAD activity catalyzes the conversion of 2,3-dihydroxyisovalerate to α-ketoisovalerate or catalyzes the conversion of 2,3-dihydroxymethylvalerate to α-ketomethylvalerate.

In certain embodiments of the invention, the isolated polypeptide or fragment thereof having DHAD activity has an amino acid sequence that matches the Profile Hidden Markov Model (HMM) of Table 6 with an E value of $<10^{-5}$. In another embodiment, the isolated polypeptide or fragment thereof having DHAD activity comprises three conserved cysteines corresponding to positions 56, 129, and 201 of *Streptococcus mutans* DHAD.

In other embodiments, the polypeptide or fragment thereof having DHAD activity is from a prokaryotic organism. In certain embodiments, the polypeptide or fragment thereof having DHAD activity is from bacteria, fungi, or plant. In a particular embodiment, the polypeptide or fragment thereof having DHAD activity is from *Streptococcus mutans*.

In certain embodiments of the invention, the isolated polypeptide or fragment thereof having DHAD activity comprises an amino acid sequence that is at least 90% identical to SEQ ID NO:528 and has a glutamic acid at position 564. In other embodiments, the isolated polypeptide or fragment thereof having DHAD activity comprises an amino acid sequence that is at least 95% identical to SEQ ID NO:528 and has a glutamic acid at position 564. In yet other embodiments, the isolated polypeptide or fragment thereof having DHAD activity comprises the amino acid sequence of SEQ ID NO:528.

In certain embodiments of the invention, the isolated polypeptide or fragment thereof having DHAD activity comprises an amino acid sequence that is at least 90% identical to SEQ ID NO:532 and has a glutamic acid at position 62 and a valine at position 562. In other embodiments, the isolated polypeptide or fragment thereof having DHAD activity comprises an amino acid sequence that is at least 95% identical to SEQ ID NO:532 and has a glutamic acid at position 62 and a valine at position 562. In yet other embodiments, the isolated polypeptide or fragment thereof having DHAD activity comprises the amino acid sequence of SEQ ID NO:532.

In certain embodiments of the invention, the isolated polypeptide or fragment thereof having DHAD activity comprises an amino acid sequence that is at least 90% identical to SEQ ID NO:534 and has an aspartic acid at position 33 and an arginine at position 563. In other embodiments, the isolated polypeptide or fragment thereof having DHAD activity comprises an amino acid sequence that is at least 95% identical to SEQ ID NO:534 and has an aspartic acid at position 33 and an arginine at position 563. In yet other embodiments, the isolated polypeptide or fragment thereof having DHAD activity comprises the amino acid sequence of SEQ ID NO:534.

In certain embodiments of the invention, the isolated polypeptide or fragment thereof having DHAD activity comprises an amino acid sequence that is at least 90% identical to SEQ ID NO:537 and has a valine at position 562. In other embodiments, the isolated polypeptide or fragment thereof having DHAD activity comprises an amino acid sequence that is at least 95% identical to SEQ ID NO:537 and has a valine at position 562. In yet other embodiments, the isolated polypeptide or fragment thereof having DHAD activity comprises the amino acid sequence of SEQ ID NO:537.

In certain embodiments of the invention, the isolated polypeptide or fragment thereof having DHAD activity comprises an amino acid sequence that is at least 90% identical to SEQ ID NO:540 and has an arginine at position 563. In other embodiments, the isolated polypeptide or fragment thereof having DHAD activity comprises an amino acid sequence that is at least 95% identical to SEQ ID NO:540 and has an arginine at position 563. In yet other embodiments, the isolated polypeptide or fragment thereof having DHAD activity comprises the amino acid sequence of SEQ ID NO:540.

In certain embodiments of the invention, the isolated polypeptide or fragment thereof having DHAD activity comprises an amino acid sequence that is at least 90% identical to SEQ ID NO:545 and has a cysteine at position 563. In other embodiments, the isolated polypeptide or fragment thereof having DHAD activity comprises an amino acid sequence that is at least 95% identical to SEQ ID NO:545 and has a cysteine at position 563. In yet other embodiments, the isolated polypeptide or fragment thereof having DHAD activity comprises the amino acid sequence of SEQ ID NO:545.

In certain embodiments of the invention, the isolated polypeptide or fragment thereof having DHAD activity comprises an amino acid sequence that is at least 90% identical to SEQ ID NO:572 and has a glycine at position 563. In other embodiments, the isolated polypeptide or fragment thereof having DHAD activity comprises an amino acid sequence that is at least 95% identical to SEQ ID NO:572 and has a glycine at position 563. In yet other embodiments, the isolated polypeptide or fragment thereof having DHAD activity comprises the amino acid sequence of SEQ ID NO:572.

In certain embodiments of the invention, the isolated polypeptide or fragment thereof having DHAD activity comprises an amino acid sequence that is at least 90% identical to SEQ ID NO:548 and has a glycine at position 524 and a glycine at position 563. In other embodiments, the isolated polypeptide or fragment thereof having DHAD activity comprises an amino acid sequence that is at least 95% identical to SEQ ID NO:548 and has a glycine at position 524 and a glycine at position 563. In yet other embodiments, the isolated polypeptide or fragment thereof having DHAD activity comprises the amino acid sequence of SEQ ID NO:548.

In certain embodiments of the invention, the isolated polypeptide or fragment thereof having DHAD activity comprises an amino acid sequence that is at least 90% identical to SEQ ID NO:552 and has a valine at position 115, an arginine at position 158, and an aspartic acid at position 567. In other embodiments, the isolated polypeptide or fragment thereof having DHAD activity comprises an amino acid sequence that is at least 95% identical to SEQ ID NO:552 and has a valine at position 115, an arginine at position 158, and an aspartic acid at position 567. In yet other embodiments, the isolated polypeptide or fragment thereof having DHAD activity comprises the amino acid sequence of SEQ ID NO:552.

In certain embodiments of the invention, the isolated polypeptide or fragment thereof having DHAD activity comprises an amino acid sequence that is at least 90% identical to SEQ ID NO:555 and has a glutamic acid at position 116 and a serine at position 119. In other embodiments, the isolated polypeptide or fragment thereof having DHAD activity comprises an amino acid sequence that is at least 95% identical to SEQ ID NO:555 and has a glutamic acid at position 116 and a serine at position 119. In yet other embodiments, the isolated polypeptide or fragment thereof having DHAD activity comprises the amino acid sequence of SEQ ID NO:555.

In certain embodiments of the invention, the isolated polypeptide or fragment thereof having DHAD activity comprises an amino acid sequence that is at least 90% identical to SEQ ID NO:557 and has an aspartic acid at position 33. In other embodiments, the isolated polypeptide or fragment thereof having DHAD activity comprises an amino acid sequence that is at least 95% identical to SEQ ID NO:557 and has an aspartic acid at position 33. In yet other embodiments, the isolated polypeptide or fragment thereof having DHAD activity comprises the amino acid sequence of SEQ ID NO:557.

In certain embodiments of the invention, the isolated polypeptide or fragment thereof having DHAD activity comprises an amino acid sequence that is at least 90% identical to SEQ ID NO:561 and has a glutamic acid at position 62. In other embodiments, the isolated polypeptide or fragment thereof having DHAD activity comprises an amino acid sequence that is at least 95% identical to SEQ ID NO:561 and has a glutamic acid at position 62. In yet other embodiments, the isolated polypeptide or fragment thereof having DHAD activity comprises the amino acid sequence of SEQ ID NO:561.

In certain embodiments of the invention, the isolated polypeptide or fragment thereof having DHAD activity comprises an amino acid sequence that is at least 90% identical to SEQ ID NO:563 and has a leucine at position 562. In other embodiments, the isolated polypeptide or fragment thereof having DHAD activity comprises an amino acid sequence that is at least 95% identical to SEQ ID NO:563 and has a leucine at position 562. In yet other embodiments, the isolated polypeptide or fragment thereof having DHAD activity comprises the amino acid sequence of SEQ ID NO:563.

In certain embodiments of the invention, the isolated polypeptide or fragment thereof having DHAD activity comprises an amino acid sequence that is at least 90% identical to SEQ ID NO:566 and has a glutamine at position 176, a leucine at position 179, an arginine at position 322, and an arginine at position 563. In other embodiments, the isolated polypeptide or fragment thereof having DHAD activity comprises an amino acid sequence that is at least 95% identical to SEQ ID NO:566 and has a glutamine at position 176, a leucine at position 179, an arginine at position 322, and an arginine at position 563. In yet other embodiments, the isolated polypeptide or fragment thereof having DHAD activity comprises the amino acid sequence of SEQ ID NO:566.

In certain embodiments of the invention, the isolated polypeptide or fragment thereof having DHAD activity comprises an amino acid sequence that is at least 90% identical to SEQ ID NO:569 and has a serine at position 425 and an arginine at position 563. In other embodiments, the isolated polypeptide or fragment thereof having DHAD activity comprises an amino acid sequence that is at least 95% identical to SEQ ID NO:569 and has a serine at position 425 and an arginine at position 563. In yet other embodiments, the isolated polypeptide or fragment thereof having DHAD activity comprises the amino acid sequence of SEQ ID NO:569.

In other embodiments, the isolated polypeptide or fragment thereof has DHAD activity that is increased relative to the DHAD activity of the polypeptide or fragment thereof without substitutions.

Another aspect of the invention is directed to an isolated polynucleotide molecule comprising a nucleotide sequence that encodes a polypeptide or fragment thereof having DHAD activity, wherein the polypeptide or fragment thereof comprises one or more amino acid substitutions selected from: (a) glycine to aspartic acid at a position corresponding to position 33 of *Streptococcus mutans* DHAD; (b) aspartic acid to glutamic acid at a position corresponding to position 62 of *Streptococcus mutans* DHAD; (c) methionine to valine at a position corresponding to position 115 of *Streptococcus mutans* DHAD; (d) glycine to glutamic acid at a position corresponding to position 116 of *Streptococcus mutans* DHAD; (e) asparagine to serine at a position corresponding to position 119 of *Streptococcus mutans* DHAD; (f) glycine to arginine at a position corresponding to position 158 of *Streptococcus mutans* DHAD; (g) histidine to glutamine at a position corresponding to position 176 of *Streptococcus mutans* DHAD; (h) histidine to leucine at a position corresponding to position 179 of *Streptococcus mutans* DHAD; (i) glutamine to arginine at a position corresponding to position 322 of *Streptococcus mutans* DHAD; (j) alanine to serine at a position corresponding to position 425 of *Streptococcus mutans* DHAD; (k) glutamic acid to glycine at a position corresponding to position 524 of *Streptococcus mutans* DHAD; (l) phenylalanine to valine or leucine at a position corresponding to position 562 of *Streptococcus mutans* DHAD; (m) tryptophan to arginine, cysteine, or glycine at a position corresponding to position 563 of *Streptococcus mutans* DHAD; (n) lysine to glutamic acid at a position corresponding to position 564 of *Streptococcus mutans* DHAD; and (o) glutamic acid to aspartic acid at a position corresponding to position 567 of *Streptococcus mutans* DHAD.

In an embodiment of the invention, the isolated polynucleotide molecule comprises a nucleotide sequence that encodes a polypeptide or fragment thereof comprising a substitution of glutamic acid at a position corresponding to position 564 of *Streptococcus mutans* DHAD. In another embodiment, the isolated polynucleotide molecule comprises a nucleotide sequence that encodes a polypeptide or fragment thereof comprising a substitution of glutamic acid at a position corresponding to position 62 of *Streptococcus mutans* DHAD, and a substitution of valine at a position corresponding to position 562 of *Streptococcus mutans* DHAD. In another embodiment, the isolated polynucleotide molecule comprises a nucleotide sequence that encodes a polypeptide or fragment thereof comprising a substitution of aspartic acid at a position corresponding to position 33 of *Streptococcus mutans* DHAD, and a substitution of arginine at a position corresponding to position 563 of *Streptococcus mutans* DHAD. In another embodiment, the isolated polynucleotide molecule comprises a nucleotide sequence that encodes a polypeptide or fragment thereof comprising a substitution of valine at a position corresponding to position 562 of *Streptococcus mutans* DHAD. In another embodiment, the isolated polynucleotide molecule comprises a nucleotide sequence that encodes a polypeptide or fragment thereof comprising a substitution of arginine at a position corresponding to position 563 of *Streptococcus mutans* DHAD. In another embodiment, the isolated polynucleotide molecule comprises a nucleotide sequence that encodes a polypeptide or fragment thereof comprising a substitution of cysteine at a position corresponding to position 563 of *Streptococcus mutans* DHAD. In another embodiment, the isolated polynucleotide molecule comprises a nucleotide sequence that encodes a polypeptide or fragment thereof comprising a substitution of glycine at a position corresponding to position 563 of *Streptococcus mutans* DHAD. In another embodiment, the isolated polynucleotide molecule comprises a nucleotide sequence that encodes a polypeptide or fragment thereof comprising a substitution of glycine at a position corresponding to position 524 of *Streptococcus mutans* DHAD, and a substitution of glycine at a position corresponding to position 563 of *Streptococcus mutans* DHAD.

In another embodiment of the invention, the isolated polynucleotide molecule comprises a nucleotide sequence that encodes a polypeptide or fragment thereof comprising a substitution of valine at a position corresponding to position 115 of *Streptococcus mutans* DHAD, a substitution of arginine at a position corresponding to position 158 of *Streptococcus mutans* DHAD, and a substitution of aspartic acid at a position corresponding to position 567 of *Streptococcus mutans* DHAD. In another embodiment, the isolated polynucleotide molecule comprises a nucleotide sequence that encodes a polypeptide or fragment thereof comprising a substitution of glutamic acid at a position corresponding to position 116 of *Streptococcus mutans* DHAD, and a substitution of serine at a position corresponding to position 119 of *Streptococcus mutans* DHAD. In another embodiment, the isolated polynucleotide molecule comprises a nucleotide sequence that encodes a polypeptide or fragment thereof comprising a substitution of aspartic acid at a position corresponding to position 33 of *Streptococcus mutans* DHAD. In another embodiment, the isolated polynucleotide molecule comprises a nucleotide sequence that encodes a polypeptide or fragment thereof comprising a substitution of glutamic acid at a position corresponding to position 62 of *Streptococcus mutans* DHAD. In another embodiment, the isolated polynucleotide molecule comprises a nucleotide sequence that encodes a polypeptide or fragment thereof comprising a substitution of leucine at a position corresponding to position 562 of *Streptococcus mutans* DHAD. In another embodiment, the isolated polynucleotide molecule comprises a nucleotide sequence that encodes a polypeptide or fragment thereof comprising a substitution of glutamine at a position corresponding to position 176 of *Streptococcus mutans* DHAD, a substitution of leucine at a position corresponding to position 179 of *Streptococcus mutans* DHAD, a substitution of arginine at a position corresponding to position 322 of *Streptococcus mutans* DHAD, and a substitution of arginine at a position corresponding to position 563 of *Streptococcus mutans* DHAD. In yet another embodiment, the isolated polynucleotide molecule comprises a nucleotide sequence that encodes a polypeptide or fragment thereof comprising a substitution of serine at a position corresponding to position 425 of *Streptococcus mutans* DHAD, and a substitution of arginine at a position corresponding to position 563 of *Streptococcus mutans* DHAD.

In another aspect, the invention is directed to an isolated polynucleotide molecule comprising a nucleotide sequence that encodes a polypeptide or fragment thereof having dihydroxy-acid dehydratase (DHAD) activity, wherein the polypeptide or fragment thereof comprises one or more amino acid substitutions selected from: (a) glycine to aspartic acid at position 33; (b) aspartic acid to glutamic acid at position 62; (c) methionine to valine at position 115; (d) glycine to glutamic acid at position 116; (e) asparagine to serine at position 119; (f) glycine to arginine at position 158; (g) histidine to glutamine at position 176; (h) histidine to leucine at position 179; (i) glutamine to arginine at position 322; (j) alanine to serine at position 425; (k) glutamic acid to glycine at position 524; (l) phenylalanine to valine or leucine at position 562; (m) tryptophan to arginine, cysteine, or glycine at position 563; (n) lysine to glutamic acid at position 564; and (o) glutamic acid to aspartic acid at position 567.

In certain embodiments, the isolated polynucleotide molecule comprising a nucleotide sequence that encodes a polypeptide or fragment thereof having dihydroxy-acid dehydratase (DHAD) activity comprises a sequence selected from the group consisting of: SEQ ID NO:527, SEQ ID NO:529, SEQ ID NO:530, SEQ ID NO:531, SEQ ID NO:533, SEQ ID NO:535, SEQ ID NO:536, SEQ ID NO:538, SEQ ID NO:539, SEQ ID NO:606, SEQ ID NO:541, SEQ ID NO:542, SEQ ID NO:543, SEQ ID NO:544, SEQ ID NO:546, SEQ ID NO:547, SEQ ID NO:549, SEQ ID NO:550, SEQ ID NO:551, SEQ ID NO:553, SEQ ID NO:554, SEQ ID NO:556, SEQ ID NO:558, SEQ ID NO:559, SEQ ID NO:560, SEQ ID NO:562, SEQ ID NO:564, SEQ ID NO:565, SEQ ID NO:567, SEQ ID NO:568, SEQ ID NO:570, and SEQ ID NO:571.

In other embodiments, the invention is directed to an isolated polynucleotide molecule comprising a nucleotide sequence that encodes a polypeptide or fragment thereof having dihydroxy-acid dehydratase (DHAD) activity, wherein the polypeptide or fragment thereof having DHAD activity is a $[2Fe-2S]^{2+}$ DHAD. In other embodiments, the invention is directed to an isolated polynucleotide molecule comprising a nucleotide sequence that encodes a polypeptide or fragment thereof having DHAD activity, wherein the polypeptide or fragment thereof having DHAD activity is a $[4Fe-4S]^{2+}$ DHAD. In other embodiments, the invention is directed to an isolated polynucleotide molecule comprising a nucleotide sequence that encodes a polypeptide or fragment thereof having DHAD activity, wherein the polypeptide or fragment thereof having DHAD activity catalyzes the conversion of 2,3-dihydroxyisovalerate to α-ketoisovalerate or catalyzes the conversion of 2,3-dihydroxymethylvalerate to α-ketomethylvalerate.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof has an amino acid sequence that matches the Profile Hidden Markov Model (HMM) of Table 6 with an E value of $<10^{-5}$. In another embodiment, the isolated polynucleotide molecule comprises a nucleotide sequence that encodes a polypeptide or fragment thereof having DHAD activity, wherein the polypeptide or fragment thereof comprises three conserved cysteines corresponding to positions 56, 129, and 201 of *Streptococcus mutans* DHAD.

In certain embodiments of the invention, the isolated polynucleotide molecule comprises a nucleotide sequence that encodes a polypeptide or fragment thereof having DHAD activity, wherein the polypeptide or fragment thereof having DHAD activity is from a prokaryotic organism. In certain embodiments, the isolated polynucleotide molecule comprises a nucleotide sequence that encodes a polypeptide or fragment thereof having DHAD activity from bacteria, fungi, or plant. In a particular embodiment, the isolated polynucleotide molecule comprises a nucleotide sequence that encodes a polypeptide or fragment thereof having DHAD activity from *Streptococcus mutans*.

In certain embodiments of the invention, the isolated polynucleotide molecule comprises a nucleotide sequence that encodes a polypeptide or fragment thereof having DHAD activity, wherein the polypeptide or fragment thereof having DHAD activity comprises an amino acid sequence that is at least 90% identical to SEQ ID NO:528 and has a glutamic acid at position 564. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:528 and has a glutamic acid at position 564. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:528.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:532 and has a glutamic acid at position 62 and a valine at position 562. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:532 and has a glutamic acid at position 62 and a valine at position 562. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:532.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:534 and has an aspartic acid at position 33 and an arginine at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:534 and has an aspartic acid at position 33 and an arginine at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:534.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:537 and has a valine at position 562. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:537 and has a valine at position 562. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:537.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:540 and has an arginine at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:540 and has an arginine at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:540.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:545 and has a cysteine at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:545 and has a cysteine at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:545.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:572 and has a glycine at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:572 and has a glycine at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:572.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:548 and has a glycine at position 524 and a glycine at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:548 and has a glycine at position 524 and a glycine at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:548.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:552 and has a valine at position 115, an arginine at position 158, and an aspartic acid at position 567. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:552 and has a valine at position 115, an arginine at position 158, and an aspartic acid at position 567. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:552.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:555 and has a glutamic acid at position 116 and a serine at position 119. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:555 and has a glutamic acid at position 116 and a serine at position 119. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:555.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:557 and has an aspartic acid at position 33. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:557 and has an aspartic acid at position 33. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:557.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:561 and has a glutamic acid at position 62. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:561 and has a glutamic acid at position 62. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:561.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:563 and has a leucine at position 562. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:563 and has a leucine at position 562. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:563.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:566 and has a glutamine at position 176, a leucine at position 179, an arginine at position 322, and an arginine at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:566 and has a glutamine at position 176, a leucine at position 179, an arginine at position 322, and an arginine at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:566.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 90% identical to SEQ ID NO:569 and has a serine at position 425 and an arginine at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:569 and has a serine at position 425 and an arginine at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:569.

In other embodiments, the isolated polynucleotide molecule comprises a nucleotide sequence that encodes a polypeptide or fragment thereof having dihydroxy-acid dehydratase (DHAD) activity, wherein the polypeptide or fragment has DHAD activity that is increased relative to the DHAD activity of the polypeptide or fragment thereof without substitutions.

In certain embodiments, the isolated polynucleotide molecule is operatively linked to a promoter sequence. In other embodiments, the isolated polynucleotide molecule is comprised within a vector.

The invention also provides polypeptides encoded by the isolated nucleic acid molecules described herein.

Another aspect of the invention is directed to a recombinant host cell comprising the isolated nucleic acid molecules of the invention or a vector of the invention. In certain embodiments, the DHAD encoded by the isolated nucleic acid molecule is heterologous to the recombinant host cell. In other embodiments, the DHAD encoded by the isolated nucleic acid molecule is over-expressed in the recombinant host cell.

In still other embodiments, the recombinant host cell of the invention is a bacterial cell or a yeast cell. In some embodiments, the recombinant host cell of the invention is a bacterial cell, and the bacterial cell is a member of a genus of bacteria selected from *Clostridium, Zymomonas, Escherichia, Salmonella, Rhodococcus, Pseudomonas, Bacillus, Lactobacillus, Enterococcus, Pediococcus, Alcaligenes, Klebsiella, Paenibacillus, Arthrobacter, Corynebacterium, Brevibacterium, Lactococcus, Leuconostoc, Oenococcus, Pediococcus*, and *Streptococcus*. In other embodiments, the recombinant host cell of the invention is a yeast cell, and the yeast cell is a member of a genus of yeast selected from *Saccharomyces, Schizosaccharomyces, Hansenula, Kluyveromyces, Candida, Pichia*, and *Yarrowia*. In other embodiments, the recombinant host cell of the invention is *Saccharomyces cerevisiae, Schizosaccharomyces pombe, Kluyveromyces lactis, Kluyveromyces thermotolerans, Candida glabrata, Candida albicans, Pichia stipitis*, or *Yarrowia lipolytica*. In another embodiment, the recombinant host cell of the invention is *Saccharomyces cerevisiae*.

In some embodiments, the recombinant host cell of the invention is a yeast cell and the yeast cell further comprises a disruption in an endogenous ILV3 gene that encodes mitochondrial DHAD. In other embodiments, the yeast cell further comprises a disruption in one or more endogenous genes affecting iron-sulfur cluster biosynthesis selected from FRA2, GRX3, and GRX4. In yet other embodiments, the yeast cell has been further genetically engineered to upregulate the activity of at least one gene selected from AFT1 and AFT2.

In some embodiments, the recombinant host cell of the invention is a bacterial cell, and the bacterial cell is a *Lactobacillus*. In other embodiments, the *Lactobacillus* further comprises at least one recombinant genetic expression element encoding iron-sulfur (Fe—S) cluster forming proteins. In yet other embodiments, the recombinant genetic expression element encoding iron-sulfur cluster forming proteins contains coding regions of an operon selected from Isc, Suf, and Nif operons. In some embodiments, the Suf operon comprises at least one coding region selected from SufC, SufD, SufS, SufU, SufB, SufA, and yseH. In some embodiments, the Suf operon is derived from *Lactococcus lactis* or *Lactobacillus plantarum*. In some embodiments, the Isc operon comprises at least one coding region selected from IscS, IscU, IscA, IscX, HscA, HscB, and Fdx. In some embodiments, the Isc operon is derived from *Escherichia coli*. In some embodiments, the Nif operon comprises at least one coding region selected from NifS and NifU. In some embodiments, the Nif operon is derived from *Wolinella succinogenes*.

In some embodiments, the recombinant host cell of the invention produces butanol, for example, isobutanol. In other embodiments, the recombinant host cell of the invention comprises an isobutanol biosynthetic pathway. In some embodiments, the isobutanol biosynthetic pathway comprises genes encoding acetolactate synthase, acetohydroxy acid isomeroreductase, DHAD, α-keto acid decarboxylase, and alcohol dehydrogenase. In another embodiment, the isobutanol biosynthetic pathway comprises the following substrate to product conversions: (i) pyruvate to acetolactate; (ii) acetolactate to 2,3-dihydroxyisovalerate; (iii) 2,3-dihydroxyisovalerate to α-ketoisovalerate; (iv) α-ketoisovalerate to isobutyraldehyde; and (v) isobutyraldehyde to isobutanol.

The substrate to product conversion of pyruvate to acetolactate can be catalyzed in some embodiments by an acetolactate synthase. The substrate to product conversion of acetolactate to 2,3-dihydroxyisovalerate can be catalyzed in some embodiments by a ketol-acid reductoisomerase. The substrate to product conversion of 2,3-dihydroxyisovalerate to α-ketoisovalerate can be catalyzed in some embodiments by a DHAD. The substrate to product conversion of α-ketoisovalerate to isobutyraldehyde can be catalyzed in some embodiments by an α-keto acid decarboxylase. The substrate to product conversion of isobutyraldehyde to isobutanol can be catalyzed in some embodiments by an alcohol dehydrogenase.

In some embodiments, two or more of: acetolactate synthase, ketol-acid reductoisomerase, and α-keto acid decarboxylase are heterologous to the recombinant host cell. In other embodiments, two or more of: acetolactate synthase, ketol-acid reductoisomerase, and α-keto acid decarboxylase are over-expressed in the recombinant host cell.

In some embodiments, the recombinant host cell comprising an isolated nucleic acid molecule of the invention produces an isobutanol titer that is increased as compared to a recombinant host cell that does not contain a polypeptide or fragment thereof having DHAD activity comprising one or more amino acid substitutions. In some embodiments, the recombinant host cell comprising the isolated nucleic acid molecule produces isobutanol at a rate that is increased by from about 10% to about 300% as compared to a recombinant host cell that does not contain a polypeptide or fragment thereof having DHAD activity comprising one or more amino acid substitutions. In some embodiments, the recombinant host cell comprising the isolated nucleic acid molecules produces isobutanol at a rate that is increased by at least about 10%, at least about 20%, at least about 30%, at least about 40%, or at least about 50% as compared to a recombinant host cell that does not contain a polypeptide or fragment thereof having DHAD activity comprising one or more amino acid substitutions. In other embodiments, the polypeptide or fragment thereof having DHAD activity is expressed in the cytosol, or the polypeptide or fragment thereof having DHAD activity and the ketol-acid reductoisomerase are expressed in the cytosol.

Another aspect of the invention is directed to a method for the production of butanol, for example, isobutanol, comprising providing a recombinant host cell comprising an isolated nucleic acid molecule of the invention; culturing the recombinant host cell in a fermentation medium under suitable conditions to produce isobutanol from pyruvate; and recovering the isobutanol. In some embodiments, the isobutanol is produced at a titer that is increased as compared to a recombinant host cell that does not contain a polypeptide or fragment thereof having DHAD activity comprising one or more amino acid substitutions. In other embodiments, the isobutanol is produced at a rate that is increased by from about 10% to about 300% as compared to a recombinant host cell that does not contain a polypeptide or fragment thereof having DHAD activity comprising one or more amino acid substitutions. In other embodiments, the isobutanol is produced at a rate that is increased by at least about 10%, at least about 20%, at least about 30%, at least about 40%, or at least about 50% as compared to a recombinant host cell that does not contain a polypeptide or fragment thereof having DHAD activity comprising one or more amino acid substitutions. In another embodiment, the concentration of isobutanol in the fermentation medium is greater than or equal to about 20 mM. In another embodiment, the concentration of isobutanol in the fermentation medium is from about 30 mM to about 50 mM.

Another aspect of the invention is directed to a method of converting 2,3-dihydroxyisovalerate to α-ketoisovalerate or 2,3-dihydroxymethylvalerate to α-ketomethylvalerate, comprising providing an isolated polypeptide or fragment thereof of the invention, wherein the isolated polypeptide or fragment thereof catalyzes the conversion of 2,3-dihydroxyisovalerate to α-ketoisovalerate or 2,3-dihydroxymethylvalerate to α-ketomethylvalerate. In some embodiments of the method to convert 2,3-dihydroxyisovalerate to α-ketoisovalerate or 2,3-dihydroxymethylvalerate to α-ketomethylvalerate, the isolated polypeptide or fragment thereof is comprised within a recombinant host cell.

In some embodiments of the method to convert 2,3-dihydroxyisovalerate to α-ketoisovalerate or 2,3-dihydroxymethylvalerate to α-ketomethylvalerate, the recombinant host cell is cultured in a fermentation medium under suitable conditions to produce isobutanol from pyruvate, and the isobutanol is recovered. In some embodiments, the isobutanol is recovered by distillation, liquid-liquid extraction, adsorption, decantation, pervaporation, or combinations thereof. In some embodiments, solids are removed from the fermentation medium. In some embodiments, solids are removed from the fermentation medium by centrifugation, filtration, decantation, or combinations thereof. In other embodiments, the solids are removed before the isobutanol is recovered. In other embodiments, the conversion of 2,3-dihydroxyisovalerate to α-ketoisovalerate or 2,3-dihydroxymethylvalerate to α-ketomethylvalerate is improved as compared to a control conversion under the same conditions with a control polypeptide having DHAD activity which does not comprise an amino acid substitution.

Another aspect of the invention is directed to a composition comprising one or more recombinant host cells of the invention, and a fermentable carbon substrate.

Another aspect of the invention is directed to a composition comprising one or more recombinant host cells of the invention, and isobutanol. In other embodiments, the composition further comprises an extractant.

In some embodiments of the method of screening DHAD protein variants, the weak promoter is a truncated Leu2 promoter. In certain embodiments, the truncated Leu2 promoter is SEQ ID NO:575. In other embodiments of the method of screening DHAD protein variants, the weak promoter is a truncated FBA promoter. In certain embodiments, the truncated FBA promoter is SEQ ID NO:576.

In some embodiments of the method of screening DHAD protein variants, the low copy number plasmid has a copy number of one or two in yeast. In certain embodiments, the low copy number plasmid is pRS413.

In other embodiments of the method of screening DHAD protein variants, the growth of the strain is under oxygen limiting conditions. In yet other embodiments, the yeast strain is further transformed with genes encoding acetolactate synthase, acetohydroxy acid isomeroreductase, α-keto acid decarboxylase, and alcohol dehydrogenase. In certain embodiments of the method of screening DHAD protein variants, the method further comprises determining the rate of isobutanol production of the transformants.

Another aspect of the invention is directed to isolated polynucleotides comprising a nucleic acid sequence encoding a DHAD variant obtained by the methods of screening DHAD protein variants described herein. The invention is also directed to isolated DHAD variant polypeptides encoded by these nucleic acid sequences.

Another aspect of the invention is directed to recombinant host cells transformed with an isolated nucleic acid molecule comprising the nucleic acid sequence of SEQ ID NO:573. Another aspect of the invention is directed to recombinant host cells transformed with an isolated nucleic acid molecule comprising the nucleic acid sequence of SEQ ID NO:574.

DESCRIPTION OF THE DRAWINGS

The accompanying drawings, which are incorporated herein and form a part of the specification, illustrate the present invention and, together with the description, further serve to explain the principles of the invention and to enable a person skilled in the pertinent art to make and use the invention.

DESCRIPTION OF THE INVENTION

Figure 1:
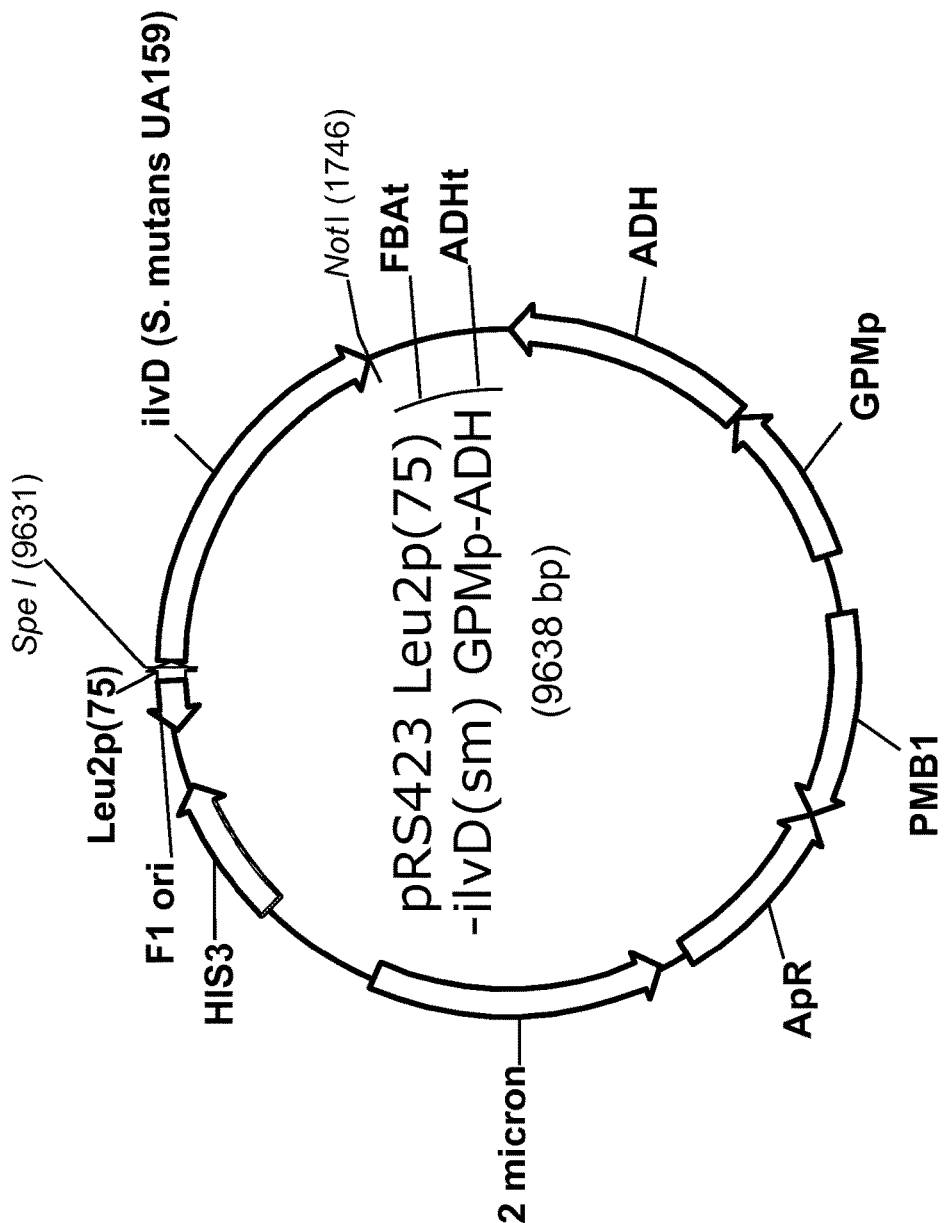
FIG. 1 is a schematic diagram of plasmid pRS423 Leu2p (75)-IlvD (sm) GPMp-ADH (SEQ ID NO:549).

For improved production of compounds synthesized in pathways including dihydroxy-acid dehydratase (DHAD), it is desirable to express a heterologous DHAD enzyme that provides this enzymatic activity in the production host of interest. However, there exists a need for alternative DHAD enzymes and DHAD variants that display increased activity as compared to a parental DHAD enzyme in heterologous organisms and for screening methods to identify such enzymes and variants. Such enzymes and variants can be employed for production of compounds from DHAD-requiring biosynthetic pathways.

The present invention satisfies these and other needs, and provides further related advantages, as will be made apparent by the description of the embodiments that follow.

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes.

DEFINITIONS

In order to further define this invention, the following terms and definitions are herein provided.

As used herein, the terms "comprises," "comprising," "includes," "including," "has," "having," "contains," or "containing," or any other variation thereof, will be understood to imply the inclusion of a stated integer or group of integers but not the exclusion of any other integer or group of integers. For example, a composition, a mixture, a process, a method, an article, or an apparatus that comprises a list of elements is not necessarily limited to only those elements but can include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the term "consists of," or variations such as "consist of" or "consisting of," as used throughout the specification and claims, indicate the inclusion of any recited integer or group of integers, but that no additional integer or group of integers can be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition.

Also, the indefinite articles "a" and "an" preceding an element or component of the invention are intended to be nonrestrictive regarding the number of instances, that is, occurrences of the element or component. Therefore, "a" or "an" should be read to include one or at least one, and the singular word form of the element or component also includes the plural unless the number is obviously meant to be singular.

The terms "invention" or "present invention" as used herein are non-limiting terms and are not intended to refer to any single embodiment of the particular invention but encompass all possible embodiments as described in the application.

As used herein, the term "about" modifying the quantity of an ingredient or reactant of the invention employed refers to variation in the numerical quantity that can occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value; in another embodiment, within 5% of the reported numerical value.

The term "alcohol" as used herein refers to any of a series of hydroxyl compounds, the simplest of which are derived from saturated hydrocarbons, having the general formula $C_nH_{2n+1}OH$. Examples of alcohol include ethanol and butanol.

The term "butanol" as used herein refers to n-butanol, 2-butanol, isobutanol, tert-butyl alcohol, individually or any mixtures thereof. Butanol can be from a biological source (i.e., biobutanol), for example.

The term "[2Fe-2S]$^{2+}$ DHAD" refers to DHAD enzymes having a bound [2Fe-2S]$^{2+}$ iron-sulfur cluster.

The term "[4Fe-4S]$^{2+}$ DHAD" refers to DHAD enzymes having a bound [4Fe-4S]$^{2+}$ iron-sulfur cluster.

The term "acetohydroxy acid dehydratase" and "dihydroxy-acid dehydratase" ("DHAD") refers to a polypeptide having enzyme activity that catalyzes the conversion of 2,3-dihydroxyisovalerate to α-ketoisovalerate or the conversion of 2,3-dihydroxymethylvalerate to α-ketomethylvalerate. Example dihydroxy-acid dehydratases are known by the EC number 4.2.1.9. Such enzymes are available from a vast array of microorganisms including, but not limited to, *Escherichia coli* (GenBank Nos: YP_026248, NC_000913), *Saccharomyces cerevisiae* (GenBank Nos: NP_012550, NC_001142), *Methanococcus maripaludis* (GenBank Nos: CAF29874, BX957219), *Bacillus subtilis* (GenBank Nos: CAB14105, Z99115), *Lactobacillus lactis*, and *Neurospora crassa*. U.S. Patent Application Publication No. 2010/0081154 and U.S. Pat. No. 7,851,188, both of which are incorporated herein by reference, describe dihydroxy-acid dehydratases including a dihydroxy-acid dehydratase from *Streptococcus mutans* (nucleic acid: SEQ ID NO:167; amino acid: SEQ ID NO:168). Dihydroxy-acid dehydratases also include, for example, the variant dihydroxy-acid dehydratases described herein.

"Increased" or "improved" properties of the DHAD variants of the invention is assessed in comparison to other DHAD enzymes, for example, a wild type DHAD, a parent DHAD, a non-substituted DHAD, or other reference DHAD. Such assessments include, but are not limited to, enzyme stability, solubility, activity, expression level, substrate to product conversion and/or isobutanol production. Methods for making these assessments are known and described in the present application.

The term "isobutanol biosynthetic pathway" as used herein refers to an enzyme pathway to produce isobutanol from pyruvate.

The terms "acetohydroxyacid synthase," "acetolactate synthase," and "acetolactate synthetase" (abbreviated "ALS") are used interchangeably herein to refer to a polypeptide having enzyme activity that catalyzes the conversion of pyruvate to acetolactate and $CO_2$. Example acetolactate synthases are known by the EC number 2.2.1.6 (Enzyme Nomenclature 1992, Academic Press, San Diego). These enzymes are available from a number of sources including, but not limited to, *Bacillus subtilis* (GenBank Nos. CAB07802.1, CAB15618, and Z99122, NCBI (National Center for Biotechnology Information) amino acid sequence, NCBI nucleotide sequence, respectively), *Klebsiella pneumoniae* (GenBank Nos. AAA25079 and M73842), and *Lactococcus lactis* (GenBank Nos. AAA25161 and L16975).

The terms "ketol-acid reductoisomerase" ("KARI"), "acetohydroxy acid reductoisomerase," and "acetohydroxy acid isomeroreductase" are used interchangeably herein to refer a polypeptide having enzyme activity that catalyzes the reaction of (S)-acetolactate to 2,3-dihydroxyisovalerate. Example KARI enzymes are classified as EC number 1.1.1.86 (Enzyme Nomenclature 1992, Academic Press, San Diego), and are available from a vast array of microorganisms including, but not limited to, *Escherichia coli* (GenBank Nos. NP_418222 and NC_000913), *Saccharomyces cerevisiae* (GenBank Nos. NP_013459 and NC_001144), *Methanococcus maripaludis* (GenBank Nos. CAF30210 and BX957220), and *Bacillus subtilis* (GenBank Nos. CAB14789 and Z99118). KARIs include, for example, *Anaerostipes caccae* KARI variants "K9G9," "K9D3," and "K9JB4P" (SEQ ID NO:569). k9jb4pKARI enzymes are also described in U.S. Pat. Nos. 7,910,342 and 8,129,162, U.S. Patent Application Publication No. 2010/0197519, and PCT Application Publication Nos. WO2011/041415 and WO2012/129555, all of which are incorporated herein by reference. Examples of KARIs disclosed therein include those from *Lactococcus lactis*, *Vibrio cholera*, *Pseudomonas aeruginosa* PAO1, *Pseudomonas fluorescens* PF5, and *Anaerostipes caccae*. In some embodiments, the KARI may utilize NADH (reduced nicotinamide adenine dinucleotide). In some embodiments, the KARI may utilize NADPH (reduced nicotinamide adenine dinucleotide phosphate).

The terms "branched-chain α-keto acid decarboxylase," "α-ketoacid decarboxylase," "α-ketoisovalerate decarboxylase," and "2-ketoisovalerate decarboxylase" ("KIVD") are used interchangeably herein to refer to a polypeptide having enzyme activity that catalyzes the conversion of α-ketoisovalerate to isobutyraldehyde and $CO_2$. Example branched-chain α-keto acid decarboxylases are known by the EC number 4.1.1.72 and are available from a number of sources including, but not limited to, *Lactococcus lactis* (GenBank Nos. AAS49166, AY548760, CAG34226, and AJ746364), *Salmonella typhimurium* (GenBank Nos. NP_461346 and NC_003197), *Clostridium acetobutylicum* (GenBank Nos. NP_149189 and NC_001988), *Macrococcus caseolyticus*, and *Listeria grayi*.

The terms "branched-chain alcohol dehydrogenase" and "alcohol dehydrogenase" ("ADH") are used interchangeably herein to refer to a polypeptide having enzyme activity that catalyzes the conversion of isobutyraldehyde to isobutanol. Example branched-chain alcohol dehydrogenases are known by the EC number 1.1.1.265, but can also be classified under other alcohol dehydrogenases (e.g., EC numbers 1.1.1.1 or 1.1.1.2). Alcohol dehydrogenases can be, for example, NADPH dependent or NADH dependent. Such enzymes are available from a number of sources including, but not limited to, *Saccharomyces cerevisiae* (GenBank Nos. NP_010656, NC_001136, NP_014051, and NC_001145), *Escherichia coli* (GenBank Nos. NP_417484 and NC_000913), and *Clostridium acetobutylicum* (GenBank Nos. NP_349892, NC_003030, NP_349891, and NC_003030). U.S. Pat. No. 8,188,250 (incorporated herein by reference) describes SadB, an alcohol dehydrogenase (ADH) from *Achromobacter xylosoxidans*. Alcohol dehydrogenases also include horse liver ADH and *Beijerinkia indica* ADH (as described in U.S. Patent Application Publication No. 2011/0269199, which is incorporated herein by reference).

The terms "carbon substrate" and "fermentable carbon substrate" are used interchangeably herein to refer to a carbon source capable of being metabolized by host organisms of the present invention and particularly carbon sources selected from the group consisting of monosaccharides, oligosaccharides, polysaccharides, and one-carbon substrates or mixtures thereof. Carbon substrates can include six-carbon (C6) and five-carbon (C5) sugars and mixtures thereof, such as, for example, glucose, sucrose, or xylose.

The term "polynucleotide" as used herein encompasses a singular nucleic acid as well as plural nucleic acids, and refers to a nucleic acid molecule or construct, for example, messenger RNA (mRNA) or plasmid DNA (pDNA). A polynucleotide can contain the nucleotide sequence of the full-length cDNA sequence, or a fragment thereof, including the untranslated 5' and 3' sequences and the coding sequences. The polynucleotide can be composed of any polyribonucleotide or polydeoxyribonucleotide, which can be unmodified RNA or DNA or modified RNA or DNA. For example, polynucleotides can be composed of single- and double-stranded DNA, DNA that is a mixture of single- and double-stranded regions, single- and double-stranded RNA, and RNA that is mixture of single- and double-stranded regions, hybrid molecules comprising DNA and RNA that can be single-stranded or, more typically, double-stranded or a mixture of single- and double-stranded regions. "Polynucleotide" embraces chemically, enzymatically, or metabolically modified forms.

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene can comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign gene" or "heterologous gene" refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

As used herein, the term "coding region" refers to a DNA sequence that codes for a specific amino acid sequence. "Suitable regulatory sequences" refers to nucleotide sequences located upstream (5' non-coding sequences), within, or downstream (3' non-coding sequences) of a coding sequence, and which influence the transcription, RNA processing or stability, or translation of the associated coding sequence. Regulatory sequences can include promoters, translation leader sequences, introns, polyadenylation recognition sequences, RNA processing site, effector binding site and stem-loop structure.

"Regulatory sequences" refers to nucleotide sequences located upstream (5' non-coding sequences), within, or downstream (3' non-coding sequences) of a coding sequence, and which influence the transcription, RNA processing or stability, or translation of the associated coding sequence. Regulatory sequences can include promoters, enhancers, operators, repressors, transcription termination signals, translation leader sequences, introns, polyadenylation recognition sequences, RNA processing site, effector binding site and stem-loop structure.

The term "promoter" refers to a DNA sequence capable of controlling the expression of a coding sequence or functional RNA. In general, a coding sequence is located 3' to a promoter sequence. Promoters can be derived in their entirety from a native gene, or composed of different elements derived from different promoters found in nature, or even comprise synthetic DNA segments. It is understood by those skilled in the art that different promoters can direct the expression of a gene in different tissues or cell types, or at different stages of development, or in response to different environmental or physiological conditions. Promoters which cause a gene to be expressed in most cell types at most times are commonly referred to as "constitutive promoters." It is further recognized that since in most cases the exact boundaries of regulatory sequences have not been completely defined, DNA fragments of different lengths can have identical promoter activity.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression" as used herein refers to the transcription and stable accumulation of sense (mRNA) or antisense RNA derived from the nucleic acid fragment of the invention. Expression can also refer to translation of mRNA into a polypeptide.

The term "over-expression" as used herein refers to expression that is higher than endogenous expression of the same or related polynucleotide or gene. A heterologous polynucleotide or gene is also over-expressed if its expression is higher than that of a comparable endogenous gene, or if its expression is higher than that of the same polynucleotide or gene introduced by a means that does not over-express the polynucleotide or gene. For example, a polynucleotide can be expressed in a host cell from a low copy number plasmid, which is present in only limited or few copies, and the same polynucleotide can be over-expressed in a host cell from a high copy number plasmid or a plasmid with a copy number that can be regulated, which is present in multiple copies. Any means can be used to over-express a polynucleotide, so long as it increases the copies of the polynucleotide in the host cell. In addition to using a high copy number plasmid or a plasmid with a copy number that can be regulated, a polynucleotide can be over-expressed by multiple chromosomal integrations.

Expression or over-expression of a polypeptide of the invention in a recombinant host cell can be quantified according to any number of methods known to the skilled artisan and can be represented, for example, by a percent of total cell protein. The percent of total protein can be an amount selected from greater than about 0.001% of total cell protein; greater than about 0.01% of total cell protein; greater than about 0.1% of total cell protein; greater than about 0.5% of total cell protein; greater than about 1.0% of total cell protein; greater than about 2.0% of total cell protein; greater than about 3.0% of total cell protein; greater than about 4.0% of total cell protein; greater than about 5.0% of total cell protein; greater than about 6.0% of total cell protein; greater than about 7.0% of total cell protein; greater than about 8.0% of total cell protein; greater than about 9.0% of total cell protein; greater than about 10% of total cell protein; or greater than about 20% of total cell protein. In one embodiment, the amount of polypeptide expressed is greater than about 0.5% of total cell protein. In another embodiment, the amount of polypeptide expressed is greater than about 1.0% of total cell protein or greater than about 2.0% of total cell protein.

As used herein, the term "transformation" refers to the transfer of a nucleic acid fragment into a host organism, resulting in genetically stable inheritance. Host organisms containing the transformed nucleic acid fragments are referred to as "transgenic" or "recombinant" or "transformed" organisms.

The terms "plasmid" and "vector" as used herein refer to an extra chromosomal element often carrying genes which are not part of the central metabolism of the cell, and usually in the form of circular double-stranded DNA molecules. Such elements can be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

A "recombinant host cell" is defined as a host cell that has been genetically manipulated to express a biosynthetic production pathway, wherein the host cell either produces a biosynthetic product in greater quantities relative to an unmodified host cell or produces a biosynthetic product that is not ordinarily produced by an unmodified host cell.

The term "engineered" as applied to a isobutanol biosynthetic pathway refers to the isobutanol biosynthetic pathway that is manipulated, such that the carbon flux from pyruvate through the engineered isobutanol biosynthetic pathway is maximized, thereby producing an increased amount of isobutanol directly from the fermentable carbon substrate. Such engineering includes expression of heterologous polynucleotides or polypeptides, over-expression of endogenous polynucleotides or polypeptides, cytosolic localization of proteins that do not naturally localize to cytosol, increased cofactor availability, decreased activity of competitive pathways, etc.

The term "codon optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 1. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 1

The Standard Genetic Code

|   | T | C | A | G |
|---|---|---|---|---|
| T | ITT Phe (F) | TCT Ser (S) | TAT Tyr (Y) | TGT Cys (C) |
|   | TTC" | TCC" | TAC" | TGC" |
|   | TTA Leu (L) | TCA" | TAA Stop | TGA Stop |
|   | TTG" | TCG" | TAG Stop | TGG Trp (W) |
| C | CTT Leu (L) | CCT Pro (P) | CAT His (H) | CGT Arg (R) |
|   | CTC" | CCC" | CAC" | CGC" |
|   | CTA" | CCA" | CAA Gln (Q) | CGA" |
|   | CTG" | CCG" | CAG" | CGG" |
| A | ATT Ile (I) | ACT Thr (T) | AAT Asn (N) | AGT Ser (S) |
|   | ATC" | ACC" | AAC" | AGC" |
|   | ATA" | ACA" | AAA Lys (K) | AGA Arg (R) |
|   | ATG Met (M) | ACG" | AAG" | AGG" |
| G | GTT Val (V) | GCT Ala (A) | GAT Asp (D) | GGT Gly (G) |
|   | GTC" | GCC" | GAC" | GGC" |
|   | GTA" | GCA" | GAA Glu (E) | GGA" |
|   | GTG" | GCG" | GAG" | GGG" |

Many organisms display a bias for use of particular codons to code for insertion of a particular amino acid in a growing peptide chain. Codon preference, or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

As used herein, an "isolated nucleic acid fragment" or "isolated nucleic acid molecule" are used interchangeably herein and mean a polymer of RNA or DNA that is single- or double-stranded, optionally containing synthetic, non-natural, or altered nucleotide bases. An isolated nucleic acid fragment in the form of a polymer of DNA can be comprised of one or more segments of cDNA, genomic DNA, or synthetic DNA.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified, for example, in Sambrook, J., Fritsch, E. F. and Maniatis, T. Molecular Cloning: A Laboratory Manual, 2nd ed., Cold Spring Harbor Laboratory: Cold Spring Harbor, N.Y. (1989), particularly Chapter 11 and Table 11.1 therein (incorporated herein by reference in its entirety). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1× SSC, 0.1% SDS at 65° C. An additional set of stringent conditions include hybridization at 0.1×SSC, 0.1% SDS, 65° C. and washes with 2×SSC, 0.1% SDS followed by 0.1× SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook, et al., supra, 9.50-9.51). For hybridizations with shorter nucleic acids, for example, oligonucleotides, the position of mismatches becomes more important, and the length of the oligonucleotide determines its specificity (see Sambrook, et al., supra, 11.7-11.8). In one embodiment, the length for a hybridizable nucleic acid is at least about 10 nucleotides. Preferably, a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration can be adjusted as necessary according to factors such as length of the probe.

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" can be used instead of, or interchangeably with any of these terms. A polypeptide can be derived from a natural biological source or produced by recombinant technology, but is not necessarily translated from a designated nucleic acid sequence. It can be generated in any manner, including by chemical synthesis.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for purposed of the invention, as are native or recombinant polypeptides which have been separated, fractionated, or partially or substantially purified by any suitable technique.

As used herein, the term "variant" refers to a polypeptide differing from a specifically recited polypeptide of the invention, such as DHAD, by amino acid insertions, deletions, mutations, and substitutions, created using, for example, recombinant DNA techniques, such as mutagenesis. A variant also includes "silent" substitutions or "silent" mutations whereby a substitution of one or more nucleotide bases in a polynucleotide does not change the resulting amino acid sequence, but results in improved properties of the resulting polypeptide. Guidance in determining which amino acid residues can be replaced, added, or deleted without abolishing activities of interest, can be found by comparing the sequence of the particular polypeptide with that of homologous polypeptides, for example, yeast or bacterial, and minimizing the number of amino acid sequence changes made in regions of high homology (conserved regions) or by replacing amino acids with consensus sequences.

Alternatively, recombinant polynucleotide variants encoding these same or similar polypeptides can be synthesized or selected by making use of the "redundancy" in the genetic code. Various codon substitutions, such as silent changes which produce various restriction sites, can be introduced to optimize cloning into a plasmid or viral vector for expression. Mutations in the polynucleotide sequence can be reflected in the polypeptide or domains of other peptides added to the polypeptide to modify the properties of any part of the polypeptide.

Amino acid "substitutions" can be the result of replacing one amino acid with another amino acid having similar structural and/or chemical properties, for example, conservative amino acid replacements, or they can be the result of replacing one amino acid with an amino acid having different structural and/or chemical properties, for example, non-conservative amino acid replacements. "Conservative" amino acid substitutions can be made on the basis of similarity in polarity, charge, solubility, hydrophobicity, hydrophilicity, or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. Alternatively, "non-conservative" amino acid substitutions can be made by selecting the differences in polarity, charge, solubility, hydrophobicity, hydrophilicity, or the amphipathic nature of any of these amino acids. "Insertions" or "deletions" can be within the range of variation as structurally or functionally tolerated by the recombinant proteins. The variation allowed can be experimentally determined by systematically making insertions, deletions, or substitutions of amino acids in a polypeptide molecule using recombinant DNA techniques and assaying the resulting recombinant variants for activity.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, et al., J. Mol. Biol., 215:403-410, 1993). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides can be used in sequence-dependent methods of gene identification (e.g., Southern hybridization) and isolation (e.g., in situ hybridization of bacterial colonies or bacteriophage plaques). In addition, short oligonucleotides of 12-15 bases can be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, can now use all or a substantial portion of the disclosed sequences for purposes known to those skilled in this art. Accordingly, the instant invention comprises the complete sequences as reported in the accompanying Sequence Listing, as well as substantial portions of those sequences as defined herein.

The term "complementary" is used to describe the relationship between nucleotide bases that are capable of hybridizing to one another. For example, with respect to DNA, adenosine is complementary to thymine and cytosine is complementary to guanine.

The term "percent identity," as known in the art, is a relationship between two or more polypeptide sequences or two or more polynucleotide sequences, as determined by comparing the sequences. In the art, "identity" or "sequence identity" also means the degree of sequence relatedness between polypeptide or polynucleotide sequences, as the case may be, as determined by the match between strings of such sequences. "Identity" and "similarity" can be readily calculated by known methods, including but not limited to those described in: (1) Computational Molecular Biology (Lesk, A. M., Ed.) Oxford University: NY (1988); (2) Biocomputing: Informatics and Genome Projects (Smith, D. W., Ed.) Academic: NY (1993); (3) Computer Analysis of Sequence Data, Part I (Griffin, A. M., and Griffin, H. G., Eds.) Humania: NJ (1994); (4) Sequence Analysis in Molecular Biology (von Heinje, G., Ed.) Academic (1987); and (5) Sequence Analysis Primer (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations can be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (described by Higgins and Sharp, CABIOS. 5:151-153, 1989; Higgins, et al., Comput. Appl. Biosci. 8:189-191, 1992) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids, these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally, the "Clustal W method of alignment" is available and corresponds to the alignment method labeled Clustal W (described by Higgins and Sharp, CABIOS. 5:151-153, 1989; Higgins, et al., Comput. Appl. Biosci. 8:189-191, 1992; Thompson, et al., Nuc. Acid Res. 22: 4673 4680, 1994) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). After alignment of the sequences using the Clustal W program, it is possible to obtain a percent identity by viewing the sequence distances table in the same program.

It is well understood by one skilled in the art that many levels of sequence identity are useful in identifying polypeptides, from other species, wherein such polypeptides have the same or similar function or activity. Useful examples of percent identities include, but are not limited to: 55%, 60%, 65%, 70%, 75%, 80%, 85%, 90%, or 95%, or any integer percentage from 55% to 100% is useful in describing the present invention, such as 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

The term "sequence analysis software" refers to any computer algorithm or software program that is useful for the analysis of nucleotide or amino acid sequences. Sequence analysis software can be commercially available or independently developed. Typical sequence analysis software will include, but is not limited to: (1) the GCG suite of programs (Wisconsin Package Version 9.0, Genetics Computer Group (GCG), Madison, Wis.); (2) BLASTP, BLASTN, BLASTX (Altschul, et al., J. Mol. Biol. 215:403-410, 1990); (3) DNASTAR (DNASTAR, Inc. Madison, Wis.); (4) Sequencher (Gene Codes Corporation, Ann Arbor, Mich.); and (5) the FASTA program incorporating the Smith-Waterman algorithm (W. R. Pearson, Comput. Methods Genome Res., [Proc. Int. Symp.] (1994), Meeting Date 1992, 111-20. Editor(s): Suhai, Sandor. Plenum: New York, N.Y.). Within the context of this application, it will be understood that where sequence analysis software is used for analysis, that the results of the analysis will be based on the "default values" of the program referenced, unless otherwise specified. As used herein, "default values" means any set of values or parameters that originally load with the software when first initialized.

Standard recombinant DNA and molecular cloning techniques used herein are well known in the art and are described by Sambrook, J., Fritsch, E. F. and Maniatis, T., Molecular Cloning: A Laboratory Manual, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., Experiments with Gene Fusions, Cold Spring Harbor Laboratory Press, Cold Spring Harbor, N.Y. (1984); and by Ausubel, F. M. et al., Current Protocols in Molecular Biology, published by Greene Publishing Assoc. and Wiley-Interscience (1987). Additional methods used herein are in Methods in Enzymology, Volume 194, Guide to Yeast Genetics and Molecular and Cell Biology (Part A, 2004, Christine Guthrie and Gerald R. Fink (Eds.), Elsevier Academic Press, San Diego, Calif.).

"Fermentation medium" as used herein means a mixture of water, fermentable carbon substrates, dissolved solids, fermentation product and all other constituents of the material held in the fermentation vessel in which the fermentation product is being made by the reaction of fermentable carbon substrates to fermentation products, water and carbon dioxide ($CO_2$) by the microorganisms present. From time to time, as used herein, the term "fermentation broth" and "fermentation mixture" can be used synonymously with "fermentation medium."

The term "aerobic conditions" as used herein means conditions in the presence of oxygen.

The term "oxygen limiting conditions" or "microaerobic conditions" as used herein means conditions with low levels of dissolved oxygen. For example, the oxygen level may be less than about 1% of air saturation.

The term "anaerobic conditions" as used herein means conditions in the absence of oxygen. It will be understood that in many fermentation processes, an initial amount of oxygen is present at the onset of the process, but such oxygen is depleted over the course of the fermentation such that the majority of the process takes place in the absence of detectable oxygen.

As used herein, the term "yield" refers to the amount of product in grams per amount of carbon source in grams (g/g). The yield can be exemplified, for example, for glucose as the carbon source. It is understood, unless otherwise noted, that yield is expressed as a percentage of the theoretical yield. In reference to a microorganism or metabolic pathway, "theoretical yield" is defined as the maximum amount of product that can be generated per total amount of substrate as dictated by the stoichiometry of the metabolic pathway used to make the product. For example, the theoretical yield for one typical conversion of glucose to isopropanol is 0.33 g/g. As such, a yield of isopropanol from glucose of 0.297 g/g would be expressed as 90% of theoretical or 90% theoretical yield. It is understood that while in the present disclosure the yield is exemplified for glucose as a carbon source, the invention can be applied to other carbon sources and the yield can vary depending on the carbon source used. One skilled in the art can calculate yields on various carbon sources.

The term "titer" as used herein refers to the total amount of butanol isomer produced by fermentation per liter of fermentation medium. The total amount of butanol isomer includes: (i) the amount of butanol in the fermentation medium; (ii) the amount of butanol isomer recovered from the organic extractant; and (iii) the amount of butanol isomer recovered from the gas phase, if gas stripping is used.

DHAD Variants

As described herein, dihydroxy-acid dehydratase (DHAD), also called acetohydroxy acid dehydratase, catalyzes the conversion of 2,3-dihydroxyisovalerate to α-ketoisovalerate and of 2,3-dihydroxymethylvalerate to α-ketomethylvalerate. The DHAD enzyme is part of naturally occurring biosynthetic pathways producing valine, isoleucine, leucine and pantothenic acid (vitamin B5). DHAD catalyzed conversion of 2,3-dihydroxyisovalerate to α-ketoisovalerate is also a step in the multiple isobutanol biosynthetic pathways that are disclosed in commonly owned U.S. Pat. No. 7,851,188 (incorporated herein by reference). For production of compounds synthesized in pathways including DHAD, it is desirable to express a heterologous DHAD enzyme that provides DHAD enzymatic activity in a host cell. A consideration for functional expression of dihydroxy-acid dehydratases in a heterologous host is the enzyme's requirement for an iron-sulfur (Fe—S) cluster, which involves availability and proper loading of the cluster into the DHAD apo-protein.

The present invention is based, in part, on the discovery that certain variants of DHAD have DHAD activity, and, in some embodiments, improved performance compared to the parental DHAD molecule. DHAD variants are desirable for production of products produced by DHAD containing biosynthetic pathways, particularly isobutanol.

The present invention includes DHAD variants comprising amino acid substitutions that result in improved DHAD activity as indicated by increased isobutanol production. For the purposes of the present invention, amino acid substitutions were made in the *Streptococcus mutans* DHAD enzyme (SEQ ID NO:168), however, equivalent substitutions can be made in the homologous regions of DHAD enzymes from other organisms. A list of other DHAD enzymes that can be used to produce the DHAD variants of the invention is included below in Tables 3-5 Amino acids are described herein using either the full name of the amino acid or the 1-letter or 3-letter abbreviation of the amino acid, as indicated in Table 2.

TABLE 2

Amino Acids and their Abbreviations

| Amino Acid | 1-Letter Symbol | 3-Letter Symbol |
|---|---|---|
| Alanine | A | Ala |
| Arginine | R | Arg |
| Asparagine | N | Asn |
| Aspartic acid | D | Asp |
| Cysteine | C | Cys |
| Glutamine | Q | Gin |
| Glutamic Acid | E | Glu |
| Pyroglutamic acid | pQ | pGlu |
| Glycine | G | Gly |
| Histidine | H | His |
| Hydroxylysine | | Hyl |
| Hydroxyproline, 4(R)-L- | O | Hyp |
| Isoleucine | I | Ile |
| Leucine | L | Leu |
| Lysine | K | Lys |
| Methionine | M | Met |
| Phenylalanine | F | Phe |
| Proline | P | Pro |
| Serine | S | Ser |
| Threonine | T | Thr |
| Tryptophan | W | Trp |
| Tyrosine | Y | Tyr |
| Valine | V | Val |

The amino acid changes that were made and/or contemplated by the present invention to produce alternative, active DHAD enzymes are described herein, for example, by a three character code that begins with the 1-letter abbreviation of the native amino acid, followed by the amino acid position number, and followed by the 1-letter abbreviation of the identity of the substituted amino acid. For example, "K564E" refers to a lysine to glutamic acid substitution of position 564 of the DHAD.

One aspect of the invention is directed to an isolated polypeptide or fragment thereof having dihydroxy-acid dehydratase (DHAD) activity, wherein the polypeptide or fragment thereof comprises one or more amino acid substitutions (e.g., as compared to the native sequence other specifically identified sequence). In some embodiments, the isolated polypeptide or fragment thereof comprises one or more amino acid substitutions at an amino acid position selected from: (a) an amino acid corresponding to position 33 of *Streptococcus mutans* DHAD; (b) an amino acid corresponding to position 62 of *Streptococcus mutans* DHAD; (c) an amino acid corresponding to position 115 of *Streptococcus mutans* DHAD; (d) an amino acid corresponding to position 116 of *Streptococcus mutans* DHAD; (e) an amino acid corresponding to position 119 of *Streptococcus mutans* DHAD; (f) an amino acid corresponding to position 158 of *Streptococcus mutans* DHAD; (g) an amino acid corresponding to position 176 of *Streptococcus mutans* DHAD; (h) an amino acid corresponding to position 179 of *Streptococcus mutans* DHAD; (i) an amino acid corresponding to position 322 of *Streptococcus mutans* DHAD; (j) an amino acid corresponding to position 425 of *Streptococcus mutans* DHAD; (k) an amino acid corresponding to position 524 of *Streptococcus mutans* DHAD; (l) an amino acid corresponding to position 562 of *Streptococcus mutans* DHAD; (m) an amino acid corresponding to position 563 of *Streptococcus mutans* DHAD; (n) an amino acid corresponding to position 564 of *Streptococcus mutans* DHAD; and (o) an amino acid corresponding to position 567 of *Streptococcus mutans* DHAD.

In some embodiments, the invention is directed to an isolated polypeptide or fragment thereof having DHAD activity, wherein the polypeptide or fragment thereof comprises one or more amino acid substitutions selected from: (a) aspartic acid or glutamic acid at a position corresponding to position 33 of *Streptococcus mutans* DHAD; (b) aspartic acid or glutamic acid at a position corresponding to position 62 of *Streptococcus mutans* DHAD; (c) glycine, alanine, valine, leucine, isoleucine, or proline at a position corresponding to position 115 of *Streptococcus mutans* DHAD; (d) aspartic acid or glutamic acid at a position corresponding to position 116 of *Streptococcus mutans* DHAD; (e) serine, threonine, cysteine, methionine, asparagine, or glutamine at a position corresponding to position 119 of *Streptococcus mutans* DHAD; (f) arginine, lysine, or histidine at a position corresponding to position 158 of *Streptococcus mutans* DHAD; (g) serine, threonine, cysteine, methionine, asparagine, or glutamine at a position corresponding to position 176 of *Streptococcus mutans* DHAD; (h) glycine, alanine, valine, leucine, isoleucine, or proline at a position corresponding to position 179 of *Streptococcus mutans* DHAD; (i) arginine, lysine, or histidine at a position corresponding to position 322 of *Streptococcus mutans* DHAD; (j) serine, threonine, cysteine, methionine, asparagine, or glutamine at a position corresponding to position 425 of *Streptococcus mutans* DHAD; (k) glycine, alanine, valine, leucine, isoleucine, or proline at a position corresponding to position 524 of *Streptococcus mutans* DHAD; (l) glycine, alanine, valine, leucine, isoleucine, or proline at a position corresponding to position 562 of *Streptococcus mutans* DHAD; (m) arginine, lysine, histidine, cysteine, serine, threonine, methionine, asparagine, glutamine, glycine, alanine, valine, leucine, isoleucine, or proline at a position corresponding to position 563 of *Streptococcus mutans* DHAD; (n) aspartic acid or glutamic acid at a position corresponding to position 564 of *Streptococcus mutans* DHAD; and (o) aspartic acid or glutamic acid at a position corresponding to position 567 of *Streptococcus mutans* DHAD.

In another embodiment, the invention is directed to an isolated polypeptide or fragment thereof having DHAD activity, wherein the polypeptide or fragment thereof comprises one or more amino acid substitutions selected from: (a) aspartic acid at a position corresponding to position 33 of *Streptococcus mutans* DHAD; (b) glutamic acid at a position corresponding to position 62 of *Streptococcus mutans* DHAD; (c) valine at a position corresponding to position 115 of *Streptococcus mutans* DHAD; (d) glutamic acid at a position corresponding to position 116 of *Streptococcus mutans* DHAD; (e) serine at a position corresponding to position 119 of *Streptococcus mutans* DHAD; (f) arginine at a position corresponding to position 158 of *Streptococcus mutans* DHAD; (g) glutamine at a position corresponding to position 176 of *Streptococcus mutans* DHAD; (h) leucine at a position corresponding to position 179 of *Streptococcus mutans* DHAD; (i) arginine at a position corresponding to position 322 of *Streptococcus mutans* DHAD; (j) serine at a position corresponding to position 425 of *Streptococcus mutans* DHAD; (k) glycine at a position corresponding to position 524 of *Streptococcus mutans* DHAD; (l) valine or leucine at a position corresponding to position 562 of *Streptococcus mutans* DHAD; (m) arginine, cysteine, or glycine at a position corresponding to position 563 of *Streptococcus mutans* DHAD; (n) glutamic acid at a position corresponding to position 564 of *Streptococcus mutans* DHAD; and aspartic acid at a position corresponding to position 567 of *Streptococcus mutans* DHAD.

In an embodiment of the invention, the polypeptide or fragment thereof comprises a substitution of glutamic acid at a position corresponding to position 564 of *Streptococcus mutans* DHAD. In another embodiment, the polypeptide or fragment thereof comprises a substitution of glutamic acid at a position corresponding to position 62 of *Streptococcus mutans* DHAD, and a substitution of valine at a position corresponding to position 562 of *Streptococcus mutans* DHAD. In another embodiment, the polypeptide or fragment thereof comprises a substitution of aspartic acid at a position corresponding to position 33 of *Streptococcus mutans* DHAD, and a substitution of arginine at a position corresponding to position 563 of *Streptococcus mutans* DHAD. In another embodiment, the polypeptide or fragment thereof comprises a substitution of valine at a position corresponding to position 562 of *Streptococcus mutans* DHAD. In another embodiment, the polypeptide or fragment thereof comprises a substitution of arginine at a position corresponding to position 563 of *Streptococcus mutans* DHAD. In another embodiment, the polypeptide or fragment thereof comprises a substitution of cysteine at a position corresponding to position 563 of *Streptococcus mutans* DHAD. In another embodiment, the polypeptide or fragment thereof comprises a substitution of glycine at a position corresponding to position 563 of *Streptococcus mutans* DHAD. In yet another embodiment, the polypeptide or fragment thereof comprises a substitution of glycine at a position corresponding to position 524 of *Streptococcus mutans* DHAD, and a substitution of glycine at a position corresponding to position 563 of *Streptococcus mutans* DHAD.

In an embodiment of the invention, the polypeptide or fragment thereof comprises a substitution of valine at a position corresponding to position 115 of *Streptococcus mutans* DHAD, a substitution of arginine at a position corresponding to position 158 of *Streptococcus mutans* DHAD, and a substitution of aspartic acid at a position corresponding to position 567 of *Streptococcus mutans* DHAD. In another embodiment, the polypeptide or fragment thereof comprises a substitution of glutamic acid at a position corresponding to position 116 of *Streptococcus mutans* DHAD, and a substitution of serine at a position corresponding to position 119 of *Streptococcus mutans* DHAD. In another embodiment, the polypeptide or fragment thereof comprises a substitution of aspartic acid at a position corresponding to position 33 of *Streptococcus mutans* DHAD. In another embodiment, the polypeptide or fragment thereof comprises a substitution of glutamic acid at a position corresponding to position 62 of *Streptococcus mutans* DHAD. In another embodiment, the polypeptide or fragment thereof comprises a substitution of leucine at a position corresponding to position 562 of *Streptococcus mutans* DHAD. In another embodiment, the polypeptide or fragment thereof comprises a substitution of glutamine at a position corresponding to position 176 of *Streptococcus mutans* DHAD, a substitution of leucine at a position corresponding to position 179 of *Streptococcus mutans* DHAD, a substitution of arginine at a position corresponding to position 322 of *Streptococcus mutans* DHAD, and a substitution of arginine at a position corresponding to position 563 of *Streptococcus mutans* DHAD. In yet another embodiment, the polypeptide or fragment thereof comprise a substitution of serine at a position corresponding to position 425 of *Streptococcus mutans* DHAD, and a substitution of arginine at a position corresponding to position 563 of *Streptococcus mutans* DHAD.

The invention is also directed to an isolated polypeptide or fragment thereof having dihydroxy-acid dehydratase (DHAD) activity, wherein the polypeptide or fragment thereof comprises one or more amino acid substitutions selected from: (a) glycine to aspartic acid or glutamic acid at a position corresponding to position 33 of *Streptococcus mutans* DHAD; (b) aspartic acid to glutamic acid at a position corresponding to position 62 of *Streptococcus mutans* DHAD; (c) methionine to valine, glycine, alanine, leucine, isoleucine, or proline at a position corresponding to position 115 of *Streptococcus mutans* DHAD; (d) glycine to glutamic acid or aspartic acid at a position corresponding to position 116 of *Streptococcus mutans* DHAD; (e) asparagine to serine, threonine, cysteine, methionine, asparagine, or glutamine at a position corresponding to position 119 of *Streptococcus mutans* DHAD; (f) glycine to arginine, histidine, or lysine at a position corresponding to position 158 of *Streptococcus mutans* DHAD; (g) histidine to glutamine, asparagine, methionine, cysteine, threonine, or serine at a position corresponding to position 176 of *Streptococcus mutans* DHAD; (h) histidine to leucine, isoleucine, proline, glycine, alanine, or valine at a position corresponding to position 179 of *Streptococcus mutans* DHAD; (i) glutamine to arginine, histidine, or lysine at a position corresponding to position 322 of *Streptococcus mutans* DHAD; (j) alanine to serine, threonine, cysteine, methionine, asparagine, or glutamine at a position corresponding to position 425 of *Streptococcus mutans* DHAD; (k) glutamic acid to glycine, alanine, valine, leucine, isoleucine, or proline at a position corresponding to position 524 of *Streptococcus mutans* DHAD; (l) phenylalanine to glycine, alanine, valine, leucine, isoleucine, or proline at a position corresponding to position 562 of *Streptococcus mutans* DHAD; (m) tryptophan to arginine, lysine, histidine, cysteine, serine, threonine, methionine, asparagine, glutamine, glycine, alanine, valine, leucine, isoleucine, or proline at a position corresponding to position 563 of *Streptococcus mutans* DHAD; (n) lysine to glutamic acid or aspartic acid at a position corresponding to position 564 of *Streptococcus mutans* DHAD; and (o) glutamic acid to aspartic acid at a position corresponding to position 567 of *Streptococcus mutans* DHAD.

The invention is also directed to an isolated polypeptide or fragment thereof having dihydroxy-acid dehydratase (DHAD) activity, wherein the polypeptide or fragment thereof comprises one or more amino acid substitutions selected from: (a) glycine to aspartic acid at a position corresponding to position 33 of *Streptococcus mutans* DHAD; (b) aspartic acid to glutamic acid at a position corresponding to position 62 of *Streptococcus mutans* DHAD; (c) methionine to valine at a position corresponding to position 115 of *Streptococcus mutans* DHAD; (d) glycine to glutamic acid at a position corresponding to position 116 of *Streptococcus mutans* DHAD; (e) asparagine to serine at a position corresponding to position 119 of *Streptococcus mutans* DHAD; (f) glycine to arginine at a position corresponding to position 158 of *Streptococcus mutans* DHAD; (g) histidine to glutamine at a position corresponding to position 176 of *Streptococcus mutans* DHAD; (h) histidine to leucine at a position corresponding to position 179 of *Streptococcus mutans* DHAD; (i) glutamine to arginine at a position corresponding to position 322 of *Streptococcus mutans* DHAD; (j) alanine to serine at a position corresponding to position 425 of *Streptococcus mutans* DHAD; (k) glutamic acid to glycine at a position corresponding to position 524 of *Streptococcus mutans* DHAD; (l) phenylalanine to valine or leucine at a position corresponding to position 562 of *Streptococcus mutans* DHAD; (m) tryptophan to arginine, cysteine, or glycine at a position corresponding to position 563 of *Streptococcus mutans* DHAD; (n) lysine to glutamic acid at a position corresponding to position 564 of *Streptococcus mutans* DHAD; and (o) glutamic acid to aspartic acid at a position corresponding to position 567 of *Streptococcus mutans* DHAD.

In another aspect, the invention is directed to an isolated polypeptide or fragment thereof having dihydroxy-acid dehydratase (DHAD) activity, wherein the polypeptide or fragment thereof comprises one or more amino acid substitutions selected from: (a) glycine to aspartic acid or glutamic acid at position 33 of *Streptococcus mutans* DHAD; (b) aspartic acid to glutamic acid at position 62 of *Streptococcus mutans* DHAD; (c) methionine to valine, glycine, alanine, leucine, isoleucine, or proline at position 115 of *Streptococcus mutans* DHAD; (d) glycine to glutamic acid or aspartic acid at position 116 of *Streptococcus mutans* DHAD; (e) asparagine to serine, threonine, cysteine, methionine, asparagine, or glutamine at position 119 of *Streptococcus mutans* DHAD; (f) glycine to arginine, histidine, or lysine at position 158 of *Streptococcus mutans* DHAD; (g) histidine to glutamine, asparagine, methionine, cysteine, threonine, or serine at position 176 of *Streptococcus mutans* DHAD; (h) histidine to leucine, isoleucine, proline, glycine, alanine, or valine at position 179 of *Streptococcus mutans* DHAD; (i) glutamine to arginine, histidine, or lysine at position 322 of *Streptococcus mutans* DHAD; (j) alanine to serine, threonine, cysteine, methionine, asparagine, or glutamine at position 425 of *Streptococcus mutans* DHAD; (k) glutamic acid to alanine, valine, leucine, isoleucine, proline, or glycine at position 524 of *Streptococcus mutans* DHAD; (l) phenylalanine to alanine, valine, leucine, isoleucine, proline, or glycine at position 562 of *Streptococcus mutans* DHAD; (m) tryptophan to arginine, lysine, histidine, cysteine, serine, threonine, methionine, asparagine, glutamine, glycine, alanine, valine, leucine, isoleucine, or proline at position 563 of *Streptococcus mutans* DHAD; (n) lysine to glutamic acid or aspartic acid at position 564 of *Streptococcus mutans* DHAD; and (o) glutamic acid to aspartic acid at position 567 of *Streptococcus mutans* DHAD.

In another aspect, the invention is directed to an isolated polypeptide or fragment thereof having DHAD activity, wherein the polypeptide or fragment thereof comprises one or more amino acid substitutions selected from: (a) glycine to aspartic acid at position 33 of *Streptococcus mutans* DHAD; (b) aspartic acid to glutamic acid at position 62 of *Streptococcus mutans* DHAD; (c) methionine to valine at position 115 of *Streptococcus mutans* DHAD; (d) glycine to glutamic acid at position 116 of *Streptococcus mutans* DHAD; (e) asparagine to serine at position 119 of *Streptococcus mutans* DHAD; (f) glycine to arginine at position 158 of *Streptococcus mutans* DHAD; (g) histidine to glutamine at position 176 of *Streptococcus mutans* DHAD; (h) histidine to leucine at position 179 of *Streptococcus mutans* DHAD; (i) glutamine to arginine at position 322 of *Streptococcus mutans* DHAD; (j) alanine to serine at position 425 of *Streptococcus mutans* DHAD; (k) glutamic acid to glycine at position 524 of *Streptococcus mutans* DHAD; (l) phenylalanine to valine or leucine at position 562 of *Streptococcus mutans* DHAD; (m) tryptophan to arginine, cysteine, or glycine at position 563 of *Streptococcus mutans* DHAD; (n) lysine to glutamic acid at position 564 of *Streptococcus mutans* DHAD; and (o) glutamic acid to aspartic acid at position 567 of *Streptococcus mutans* DHAD.

The amino acid substitutions described herein can be made in any polypeptide or fragment thereof having DHAD activity at any corresponding position in the sequence. Exemplary DHAD enzymes that can be substituted are listed in Tables 3-5, below. Sequence alignment software can be used to identify the amino acids in the DHAD enzyme of interest that corresponds to a recited amino acid in the *Streptococcus mutans* DHAD sequence (SEQ ID NO:168). In some embodiments, the isolated polypeptide or fragment thereof having DHAD activity is a $[2Fe-2S]^{2+}$ DHAD. In other embodiments, the isolated polypeptide or fragment thereof having DHAD activity is a $[4Fe-4S]^{2+}$ DHAD. In yet other embodiments, the isolated polypeptide or fragment thereof having DHAD activity catalyzes the conversion of 2,3-dihydroxyisovalerate to α-ketoisovalerate or catalyzes the conversion of 2,3-dihydroxymethylvalerate to α-ketomethylvalerate.

In certain embodiments of the invention, the amino acid substitutions described herein can be made in an isolated polypeptide or fragment thereof having DHAD activity and having an amino acid sequence that matches the Profile Hidden Markov Model (HMM) of Table 6 with an E value of $<10^{-5}$. Table 6 is a table of the Profile Hidden Markov Model (HMM) for dihydroxy-acid dehydratases based on enzymes with assayed function. Table 6 may be found on pages 108-155.

In another embodiment, the isolated polypeptide or fragment thereof having DHAD activity comprises three conserved cysteines corresponding to positions 56, 129, and 201 of *Streptococcus mutans* DHAD.

Amino acid substitutions can be made in polypeptides or fragment thereof having DHAD activity from prokaryotic organisms or eukaryotic organisms. In certain embodiments, the polypeptide or fragment thereof having DHAD activity is from bacteria, fungi, or plant. In a particular embodiment, the polypeptide or fragment thereof having DHAD activity is from *Streptococcus mutans*.

In certain embodiments of the invention, the isolated polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:528 and has a glutamic acid or aspartic acid at position 564. In certain embodiments, the isolated polypeptide or fragment thereof having DHAD activity comprises an amino acid sequence that is at least 95% identical to SEQ ID NO:528 and has a glutamic acid or aspartic acid at position 564. In yet other embodiments, the isolated polypeptide or fragment thereof having DHAD activity comprises the amino acid sequence of SEQ ID NO:528.

In certain embodiments of the invention, the isolated polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:532 and has a glutamic acid at position 62 and a glycine, alanine, valine, leucine, isoleucine, or proline at position 562. In certain embodiments, the isolated polypeptide or fragment thereof having DHAD activity comprises an amino acid sequence that is at least 95% identical to SEQ ID NO:532 and has a glutamic acid at position 62 and a glycine, alanine, valine, leucine, isoleucine, or proline at position 562. In yet other embodiments, the isolated polypeptide or fragment thereof having DHAD activity comprises the amino acid sequence of SEQ ID NO:532.

In certain embodiments of the invention, the isolated polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:534 and has an aspartic acid at position 33 and an arginine at position 563. In certain embodiments, the isolated polypeptide or fragment thereof having DHAD activity comprises an amino acid sequence that is at least 95% identical to SEQ ID NO:534 and has an aspartic acid or glutamic acid at position 33 and an arginine, lysine, histidine, cysteine, serine, threonine, methionine, asparagine, glutamine, glycine, alanine, valine, leucine, isoleucine, or proline at position 563. In yet other embodiments, the isolated polypeptide or fragment thereof having DHAD activity comprises the amino acid sequence of SEQ ID NO:534.

In certain embodiments of the invention, the isolated polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:537 and has a glycine, alanine, valine, leucine, isoleucine, or proline at position 562. In certain embodiments, the isolated polypeptide or fragment thereof having DHAD activity comprises an amino acid sequence that is at least 95% identical to SEQ ID NO:537 and has a glycine, alanine, valine, leucine, isoleucine, or proline at position 562. In yet other embodiments, the isolated polypeptide or fragment thereof having DHAD activity comprises the amino acid sequence of SEQ ID NO:537.

In certain embodiments of the invention, the isolated polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:540 and has an arginine, lysine, histidine, cysteine, serine, threonine, methionine, asparagine, glutamine, glycine, alanine, valine, leucine, isoleucine, or proline at position 563. In certain embodiments, the isolated polypeptide or fragment thereof having DHAD activity comprises an amino acid sequence that is at least 95% identical to SEQ ID NO:540 and has an arginine, lysine, histidine, cysteine, serine, threonine, methionine, asparagine, glutamine, glycine, alanine, valine, leucine, isoleucine, or proline at position 563. In yet other embodiments, the isolated polypeptide or fragment thereof having DHAD activity comprises the amino acid sequence of SEQ ID NO:540.

In certain embodiments of the invention, the isolated polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:545 and has a arginine, lysine, histidine, cysteine, serine, threonine, methionine, asparagine, glutamine, glycine, alanine, valine, leucine, isoleucine, or proline at position 563. In certain embodiments, the isolated polypeptide or fragment thereof having DHAD activity comprises an amino acid sequence that is at least 95% identical to SEQ ID NO:545 and has a arginine, lysine, histidine, cysteine, serine, threonine, methionine, asparagine, glutamine, glycine, alanine, valine, leucine, isoleucine, or proline at position 563. In yet other embodiments, the isolated polypeptide or fragment thereof having DHAD activity comprises the amino acid sequence of SEQ ID NO:545.

In certain embodiments of the invention, the isolated polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:572 and has an arginine, lysine, histidine, cysteine, serine, threonine, methionine, asparagine, glutamine, glycine, alanine, valine, leucine, isoleucine, or proline at position 563. In certain embodiments, the isolated polypeptide or fragment thereof having DHAD activity comprises an amino acid sequence that is at least 95% identical to SEQ ID NO:572 and has an arginine, lysine, histidine, cysteine, serine, threonine, methionine, asparagine, glutamine, glycine, alanine, valine, leucine, isoleucine, or proline at position 563. In yet other embodiments, the isolated polypeptide or fragment thereof having DHAD activity comprises the amino acid sequence of SEQ ID NO:572.

In certain embodiments of the invention, the isolated polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:548 and has a glycine, alanine, valine, leucine, isoleucine, or proline at position 524 and an arginine, lysine, histidine, cysteine, serine, threonine, methionine, asparagine, glutamine, glycine, alanine, valine, leucine, isoleucine, or proline at position 563. In certain embodiments, the isolated polypeptide or fragment thereof having DHAD activity comprises an amino acid sequence that is at least 95% identical to SEQ ID NO:548 and has a glycine, alanine, valine, leucine, isoleucine, or proline at position 524 and an arginine, lysine, histidine, cysteine, serine, threonine, methionine, asparagine, glutamine, glycine, alanine, valine, leucine, isoleucine, or proline at position 563. In yet other embodiments, the isolated polypeptide or fragment thereof having DHAD activity comprises the amino acid sequence of SEQ ID NO:548.

In certain embodiments of the invention, the isolated polypeptide or fragment thereof having DHAD activity comprises an amino acid sequence that is at least 90% identical to SEQ ID NO:552 and has a valine, alanine, glycine, leucine, isoleucine, or proline at position 115, an arginine, lysine, or histidine at position 158, and an aspartic acid or glutamic acid at position 567. In other embodiments, the isolated polypeptide or fragment thereof having DHAD activity comprises an amino acid sequence that is at least 95% identical to SEQ ID NO:552 and has a valine, alanine, glycine, leucine, isoleucine, or proline at position 115, an arginine, lysine, or histidine at position 158, and an aspartic acid or glutamic acid at position 567. In yet other embodiments, the isolated polypeptide or fragment thereof having DHAD activity comprises the amino acid sequence of SEQ ID NO:552.

In certain embodiments of the invention, the isolated polypeptide or fragment thereof having DHAD activity comprises an amino acid sequence that is at least 90% identical to SEQ ID NO:555 and has a glutamic acid or aspartic acid at position 116 and a serine, threonine, cysteine, methionine, asparagine, or glutamine at position 119. In other embodiments, the isolated polypeptide or fragment thereof having DHAD activity comprises an amino acid sequence that is at least 95% identical to SEQ ID NO:555 and has a glutamic acid or aspartic acid at position 116 and a serine, threonine, cysteine, methionine, asparagine, or glutamine at position 119. In yet other embodiments, the isolated polypeptide or fragment thereof having DHAD activity comprises the amino acid sequence of SEQ ID NO:555.

In certain embodiments of the invention, the isolated polypeptide or fragment thereof having DHAD activity comprises an amino acid sequence that is at least 90% identical to SEQ ID NO:557 and has an aspartic acid or glutamic acid at position 33. In other embodiments, the isolated polypeptide or fragment thereof having DHAD activity comprises an amino acid sequence that is at least 95% identical to SEQ ID NO:557 and has an aspartic acid or glutamic acid at position 33. In yet other embodiments, the isolated polypeptide or fragment thereof having DHAD activity comprises the amino acid sequence of SEQ ID NO:557.

In certain embodiments of the invention, the isolated polypeptide or fragment thereof having DHAD activity comprises an amino acid sequence that is at least 90% identical to SEQ ID NO:561 and has a glutamic acid or aspartic acid at position 62. In other embodiments, the isolated polypeptide or fragment thereof having DHAD activity comprises an amino acid sequence that is at least 95% identical to SEQ ID NO:561 and has a glutamic acid or aspartic acid at position 62. In yet other embodiments, the isolated polypeptide or fragment thereof having DHAD activity comprises the amino acid sequence of SEQ ID NO:561.

In certain embodiments of the invention, the isolated polypeptide or fragment thereof having DHAD activity comprises an amino acid sequence that is at least 90% identical to SEQ ID NO:563 and has a leucine, glycine, alanine, valine, isoleucine, or proline at position 562. In other embodiments, the isolated polypeptide or fragment thereof having DHAD activity comprises an amino acid sequence that is at least 95% identical to SEQ ID NO:563 and has a leucine, glycine, alanine, valine, isoleucine, or proline at position 562. In yet other embodiments, the isolated polypeptide or fragment thereof having DHAD activity comprises the amino acid sequence of SEQ ID NO:563.

In certain embodiments of the invention, the isolated polypeptide or fragment thereof having DHAD activity comprises an amino acid sequence that is at least 90% identical to SEQ ID NO:566 and has a glutamine, asparagine, methionine, serine, threonine, or cysteine at position 176, a leucine, glycine, alanine, valine, isoleucine, or proline at position 179, an arginine, lysine, or histidine at position 322, and an arginine, lysine, or histidine at position 563. In other embodiments, the isolated polypeptide or fragment thereof having DHAD activity comprises an amino acid sequence that is at least 95% identical to SEQ ID NO:566 and has a glutamine, asparagine, methionine, serine, threonine, or cysteine at position 176, a leucine, glycine, alanine, valine, isoleucine, or proline at position 179, an arginine, lysine, or histidine at position 322, and an arginine, lysine, or histidine at position 563. In yet other embodiments, the isolated polypeptide or fragment thereof having DHAD activity comprises the amino acid sequence of SEQ ID NO:566.

In certain embodiments of the invention, the isolated polypeptide or fragment thereof having DHAD activity comprises an amino acid sequence that is at least 90% identical to SEQ ID NO:569 and has a glutamine, asparagine, methionine, serine, threonine, or cysteine at position 425 and an arginine, lysine, or histidine at position 563. In other embodiments, the isolated polypeptide or fragment thereof having DHAD activity comprises an amino acid sequence that is at least 95% identical to SEQ ID NO:569 and has a glutamine, asparagine, methionine, serine, threonine, or cysteine at position 425 and an arginine, lysine, or histidine at position 563. In yet other embodiments, the isolated polypeptide or fragment thereof having DHAD activity comprises the amino acid sequence of SEQ ID NO:569.

The isolated polypeptides or fragments thereof having DHAD activity of the invention display increased DHAD activity compared to DHAD proteins without the amino acid substitutions. The phrase "increased activity" refers to any alteration in the protein that results in improved growth of a strain relative to a control strain expressing the parental DHAD enzyme, or an improved yield of a product made from a DHAD requiring pathway, such as isobutanol. "Increased activity" can result from a number of alterations in the function of the polypeptide or fragment thereof having DHAD activity including, but not limited to: improved stability of the protein, faster catalytic activity, increased binding to substrate, increased stability of the mRNA leading to more translation into protein, more efficient translation of the mRNA, or improved binding to a $[4Fe-4S]^{2+}$ cluster or a $[2Fe-2S]^{2+}$ cluster. In some embodiments, DHAD variant proteins expressed in yeast cytosol have a specific activity of greater than about 0.10 units/mg, greater than about 0.15 units/mg, greater than about 0.20 units/mg, greater than about 0.25 units/mg, greater than about 0.30 units/mg, greater than about 0.35 units/mg, or greater than about 0.40 units/mg. In some embodiments, DHAD variant proteins expressed in yeast cytosol have a specific activity of about 0.10 units/mg to about 0.40 units/mg, or any range of values therein, for example, about 0.10 units/mg to about 0.35 units/mg, about 0.10 units/mg to about 0.30 units/mg, about 0.10 units/mg to about 0.25 units/mg, about 0.10 units/mg to about 0.20 units/mg, about 0.10 units/mg to about 0.15 units/mg.

The invention is also directed to isolated polynucleotide molecules comprising a nucleic acid sequence that encodes the DHAD variant polypeptides described herein.

In certain embodiments of the invention, the isolated polynucleotide molecule comprises a nucleotide sequence that encodes a polypeptide or fragment thereof having DHAD activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:528 and has a glutamic acid or aspartic acid at position 564. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:528 and has a glutamic acid or aspartic acid at position 564. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:528. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:527 and encodes a polypeptide or fragment thereof having DHAD activity. In a specific embodiment, the polynucleotide sequence comprises the nucleic acid sequence of SEQ ID NO:527. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:529 and encodes a polypeptide or fragment thereof having DHAD activity. In a specific embodiment, the polynucleotide sequence comprises the nucleic acid sequence of SEQ ID NO:529. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:530 and encodes a polypeptide or fragment thereof having DHAD activity. In a specific embodiment, the polynucleotide sequence comprises the nucleic acid sequence of SEQ ID NO:530.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:532 and has a glutamic acid at position 62 and a glycine, alanine, valine, leucine, isoleucine, or proline at position 562. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:532 and has a glutamic acid at position 62 and a glycine, alanine, valine, leucine, isoleucine or proline at position 562. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:532. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:531 and encodes a polypeptide or fragment thereof having DHAD activity. In a specific embodiment, the polynucleotide sequence comprises the nucleic acid sequence of SEQ ID NO:531.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:534 and has an aspartic acid or glutamic acid at position 33 and an arginine, lysine, histidine, cysteine, serine, threonine, methionine, asparagine, glutamine, glycine, alanine, valine, leucine, isoleucine, or proline at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:534 and has an aspartic acid or glutamic acid at position 33 and an arginine, lysine, histidine, cysteine, serine, threonine, methionine, asparagine, glutamine, glycine, alanine, valine, leucine, isoleucine, or proline at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:534. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:533 and encodes a polypeptide or fragment thereof having DHAD activity. In a specific embodiment, the polynucleotide sequence comprises the nucleic acid sequence of SEQ ID NO:533. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:535 and encodes a polypeptide or fragment thereof having DHAD activity. In a specific embodiment, the polynucleotide sequence comprises the nucleic acid sequence of SEQ ID NO:535.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:537 and has a glycine, alanine, valine, leucine, isoleucine, or proline at position 562. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:537 and has a glycine, alanine, valine, leucine, isoleucine, or proline at position 562. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:537. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:536 and encodes a polypeptide or fragment thereof having DHAD activity. In a specific embodiment, the polynucleotide sequence comprises the nucleic acid sequence of SEQ ID NO:536. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:538 and encodes a polypeptide or fragment thereof having DHAD activity. In a specific embodiment, the polynucleotide sequence comprises the nucleic acid sequence of SEQ ID NO:538.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:540 and has an arginine, lysine, histidine, cysteine, serine, threonine, methionine, asparagine, glutamine, glycine, alanine, valine, leucine, isoleucine, or proline at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:540 and has an arginine, lysine, histidine, cysteine, serine, threonine, methionine, asparagine, glutamine, glycine, alanine, valine, leucine, isoleucine, or proline at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:540. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:539 and encodes a polypeptide or fragment thereof having DHAD activity. In a specific embodiment, the polynucleotide sequence comprises the nucleic acid sequence of SEQ ID NO:539. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99° A identical to the nucleic acid sequence of SEQ ID NO:606 and encodes a polypeptide or fragment thereof having DHAD activity. In a specific embodiment, the polynucleotide sequence comprises the nucleic acid sequence of SEQ ID NO:606. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:541 and encodes a polypeptide or fragment thereof having DHAD activity. In a specific embodiment, the polynucleotide sequence comprises the nucleic acid sequence of SEQ ID NO:541. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:542 and encodes a polypeptide or fragment thereof having DHAD activity. In a specific embodiment, the polynucleotide sequence comprises the nucleic acid sequence of SEQ ID NO:542. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:543 and encodes a polypeptide or fragment thereof having DHAD activity. In a specific embodiment, the polynucleotide sequence comprises the nucleic acid sequence of SEQ ID NO:543.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:545 and has an arginine, lysine, histidine, cysteine, serine, threonine, methionine, asparagine, glutamine, glycine, alanine, valine, leucine, isoleucine, or proline at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:545 and has an arginine, lysine, histidine, cysteine, serine, threonine, methionine, asparagine, glutamine, glycine, alanine, valine, leucine, isoleucine, or proline at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:545. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:544 and encodes a polypeptide or fragment thereof having DHAD activity. In a specific embodiment, the polynucleotide sequence comprises the nucleic acid sequence of SEQ ID NO:544. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:546 and encodes a polypeptide or fragment thereof having DHAD activity. In a specific embodiment, the polynucleotide sequence comprises the nucleic acid sequence of SEQ ID NO:546.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:572 and has an arginine, lysine, histidine, cysteine, serine, threonine, methionine, asparagine, glutamine, glycine, alanine, valine, leucine, isoleucine, or proline at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:572 and has an arginine, lysine, histidine, cysteine, serine, threonine, methionine, asparagine, glutamine, glycine, alanine, valine, leucine, isoleucine, or proline at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:572. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:571 and encodes a polypeptide or fragment thereof having DHAD activity. In a specific embodiment, the polynucleotide sequence comprises the nucleic acid sequence of SEQ ID NO:571.

In certain embodiment of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:548 and has a glycine, alanine, valine, leucine, isoleucine, or proline at position 524 and an arginine, lysine, histidine, cysteine, serine, threonine, methionine, asparagine, glutamine, glycine, alanine, valine, leucine, isoleucine, or proline at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:548 and has a glycine, alanine, valine, leucine, isoleucine, or proline at position 524 and an arginine, lysine, histidine, cysteine, serine, threonine, methionine, asparagine, glutamine, glycine, alanine, valine, leucine, isoleucine, or proline at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:548. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:547 and encodes a polypeptide or fragment thereof having DHAD activity. In a specific embodiment, the polynucleotide sequence comprises the nucleic acid sequence of SEQ ID NO:547. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:549 and encodes a polypeptide or fragment thereof having DHAD activity. In a specific embodiment, the polynucleotide sequence comprises the nucleic acid sequence of SEQ ID NO:549. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:550 and encodes a polypeptide or fragment thereof having DHAD activity. In a specific embodiment, the polynucleotide sequence comprises the nucleic acid sequence of SEQ ID NO:550.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:552 and has a valine, alanine, glycine, leucine, isoleucine, or proline at position 115, an arginine, lysine, or histidine at position 158, and an aspartic acid or glutamic acid at position 567. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:552 and has a valine, alanine, glycine, leucine, isoleucine, or proline at position 115, an arginine, lysine, or histidine at position 158, and an aspartic acid or glutamic acid at position 567. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:552. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:551 and encodes a polypeptide or fragment thereof having DHAD activity. In a specific embodiment, the polynucleotide sequence comprises the nucleic acid sequence of SEQ ID NO:551. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:553 and encodes a polypeptide or fragment thereof having DHAD activity. In a specific embodiment, the polynucleotide sequence comprises the nucleic acid sequence of SEQ ID NO:553.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:555 and has a glutamic acid or aspartic acid at position 116 and a serine, threonine, cysteine, methionine, asparagine, or glutamine at position 119. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:555 and has a glutamic acid or aspartic acid at position 116 and a serine, threonine, cysteine, methionine, asparagine, or glutamine at position 119. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:555. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:554 and encodes a polypeptide or fragment thereof having DHAD activity. In a specific embodiment, the polynucleotide sequence comprises the nucleic acid sequence of SEQ ID NO:554.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:557 and has an aspartic acid or glutamic acid at position 33. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:557 and has an aspartic acid or glutamic acid at position 33. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:557. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:556 and encodes a polypeptide or fragment thereof having DHAD activity. In a specific embodiment, the polynucleotide sequence comprises the nucleic acid sequence of SEQ ID NO:556. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:558 and encodes a polypeptide or fragment thereof having DHAD activity. In a specific embodiment, the polynucleotide sequence comprises the nucleic acid sequence of SEQ ID NO:558. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:559 and encodes a polypeptide or fragment thereof having DHAD activity. In a specific embodiment, the polynucleotide sequence comprises the nucleic acid sequence of SEQ ID NO:559.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:561 and has a glutamic acid or aspartic acid at position 62. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:561 and has a glutamic acid or aspartic acid at position 62. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:561. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:560 and encodes a polypeptide or fragment thereof having DHAD activity. In a specific embodiment, the polynucleotide sequence comprises the nucleic acid sequence of SEQ ID NO:560.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:563 and has a leucine, glycine, alanine, valine, isoleucine, or proline at position 562. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:563 and has a leucine, glycine, alanine, valine, isoleucine, or proline at position 562. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:563. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:562 and encodes a polypeptide or fragment thereof having DHAD activity. In a specific embodiment, the polynucleotide sequence comprises the nucleic acid sequence of SEQ ID NO:562. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:564 and encodes a polypeptide or fragment thereof having DHAD activity. In a specific embodiment, the polynucleotide sequence comprises the nucleic acid sequence of SEQ ID NO:564.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:566 and has a glutamine, asparagine, methionine, serine, threonine, or cysteine at position 176, a leucine, glycine, alanine, valine, isoleucine, or proline at position 179, an arginine, lysine, or histidine at position 322, and an arginine, lysine, or histidine at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:566 and has a glutamine, asparagine, methionine, serine, threonine, or cysteine at position 176, a leucine, glycine, alanine, valine, isoleucine, or proline at position 179, an arginine, lysine, or histidine at position 322, and an arginine, lysine, or histidine at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:566. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:565 and encodes a polypeptide or fragment thereof having DHAD activity. In a specific embodiment, the polynucleotide sequence comprises the nucleic acid sequence of SEQ ID NO:565. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:567 and encodes a polypeptide or fragment thereof having DHAD activity. In a specific embodiment, the polynucleotide sequence comprises the nucleic acid sequence of SEQ ID NO:567.

In certain embodiments of the invention, the isolated polynucleotide molecule comprises a nucleotide sequence that encodes a polypeptide or fragment thereof having dihydroxy-acid dehydratase (DHAD) activity, wherein the polypeptide or fragment thereof having DHAD activity comprises an amino acid sequence that is at least 50%, 55%, 60%, 65%, 70%, 75%, 80%, 85%, 90%, 95%, 96%, 97%, 98%, or 99% identical to SEQ ID NO:569 and has a glutamine, asparagine, methionine, serine, threonine, or cysteine at position 425 and an arginine, lysine, or histidine at position 563. In other embodiments, the isolated polynucleotide molecule comprises a nucleotide sequence that encodes a polypeptide or fragment thereof having DHAD activity, wherein the polypeptide or fragment thereof having DHAD activity is at least 95% identical to SEQ ID NO:569 and has a glutamine, asparagine, methionine, serine, threonine, or cysteine at position 425 and an arginine, lysine, or histidine at position 563. In yet other embodiments, the isolated polynucleotide molecule comprises a nucleotide sequence that encodes a polypeptide or fragment thereof having DHAD activity, wherein the polypeptide or fragment thereof having DHAD activity comprises the amino acid sequence of SEQ ID NO:569. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:568 and encodes a polypeptide or fragment thereof having DHAD activity. In a specific embodiment, the polynucleotide sequence comprises the nucleic acid sequence of SEQ ID NO:568. In certain embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:570 and encodes a polypeptide or fragment thereof having DHAD activity. In a specific embodiment, the polynucleotide sequence comprises the nucleic acid sequence of SEQ ID NO:570.

In other embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:573 and encodes a polypeptide or fragment thereof having DHAD activity. In a specific embodiment, the polynucleotide sequence comprises the nucleic acid sequence of SEQ ID NO:573. In another embodiments, the polynucleotide sequence comprises a nucleic acid sequence that is at least 50%, 55%, 60%, 65%, 70%, 75%, 80%, 85%, 90%, 95%, 96%, 97%, 98%, or 99% identical to the nucleic acid sequence of SEQ ID NO:574 and encodes a polypeptide or fragment thereof having DHAD activity. In a specific embodiment, the polynucleotide sequence comprises the nucleic acid sequence of SEQ ID NO:574.

DHAD Proteins

Any DHAD protein can be used as a parental, or starting, molecule for creating a DHAD variant polypeptide of the invention. DHADs that can be used herein can be derived from bacterial, fungal, or plant sources. DHADs that can be used can have a $[4Fe-4S]^{2+}$ cluster or a $[2Fe-2S]^{2+}$ cluster bound by the apoprotein. Tables 3-5 list SEQ ID NOs for coding regions and proteins of representative DHADs that can be used in the present invention. Proteins with at least about 95% identity to those listed sequences have been omitted for simplification, but it is understood that omitted proteins with at least about 95% sequence identity to any of the proteins listed in Tables 3-5 and having DHAD activity can be used as disclosed herein. Additional DHAD proteins and their encoding sequences can be identified by BLAST searching of public databases, as well known to one skilled in the art. Typically BLAST (described herein) searching of publicly available databases with known DHAD sequences, such as those provided herein, is used to identify DHADs and their encoding sequences that can be expressed in the present cells. For example, DHAD proteins having amino acid sequence identities of at least about 80-85%, at least about 85-90%, at least about 90-95%, or at least about 98% sequence identity to any of the DHAD proteins disclosed herein can be expressed in the present cells. Identities are based on the Clustal W method of alignment using the default parameters of GAP PENALTY=10, GAP LENGTH PENALTY=0.1, and Gonnet 250 series of protein weight matrix.

TABLE 3

SEQ ID NOs of Representative Bacterial [2Fe—2S]$^{2+}$ DHAD Proteins and Encoding Sequences

| Organism of derivation | SEQ ID NO: Nucleic Acid | SEQ ID NO: Peptide |
|---|---|---|
| Mycobacterium sp. MCS | 1 | 2 |
| Mycobacterium gilvum PYR-GCK | 3 | 4 |
| Mycobacterium smegmatis str. MC2 155 | 5 | 6 |
| Mycobacterium vanbaalenii PYR-1 | 7 | 8 |
| Nocardia farcinica IFM 10152 | 9 | 10 |
| Rhodococcus sp. RHA1 | 11 | 12 |
| Mycobacterium ulcerans Agy99 | 13 | 14 |
| Mycobacterium avium subsp. paratuberculosis K-10 | 15 | 16 |
| Mycobacterium tuberculosis H37Ra | 17 | 18 |
| Mycobacterium leprae TN* | 19 | 20 |
| Kineococcus radiotolerans SRS30216 | 21 | 22 |
| Janibacter sp. HTCC2649 | 23 | 24 |
| Nocardioides sp. JS614 | 25 | 26 |
| Renibacterium salmoninarum ATCC 33209 | 27 | 28 |
| Arthrobacter aurescens TC1 | 29 | 30 |
| Leifsonia xyli subsp. xyli str. CTCB07 | 31 | 32 |
| marine actinobacterium PHSC20C1 | 33 | 34 |
| Clavibacter michiganensis subsp. michiganensis NCPPB 382 | 35 | 36 |
| Saccharopolyspora erythraea NRRL 2338 | 37 | 38 |
| Acidothermus cellulolyticus 11B | 39 | 40 |
| Corynebacterium efficiens YS-314 | 41 | 42 |
| Brevibacterium linens BL2 | 43 | 44 |
| Tropheryma whipplei TW08/27 | 45 | 46 |
| Methylobacterium extorquens PA1 | 47 | 48 |
| Methylobacterium nodulans ORS 2060 | 49 | 50 |
| Rhodopseudomonas palustris BisB5 | 51 | 52 |
| Rhodopseudomonas palustris BisB18 | 53 | 54 |
| Bradyrhizobium sp. ORS278 | 55 | 56 |
| Bradyrhizobium japonicum USDA 110 | 57 | 58 |
| Fulvimarina pelagi HTCC2506 | 59 | 60 |
| Aurantimonas sp. SI85-9A1 | 61 | 62 |
| Hoeflea phototrophica DFL-43 | 63 | 64 |
| Mesorhizobium loti MAFF303099 | 65 | 66 |
| Mesorhizobium sp. BNC1 | 67 | 68 |
| Parvibaculum lavamentivorans DS-1 | 69 | 70 |
| Loktanella vestfoldensis SKA53 | 71 | 72 |
| Roseobacter sp. CCS2 | 73 | 74 |
| Dinoroseobacter shibae DFL 12 | 75 | 76 |
| Roseovarius nubinhibens ISM | 77 | 78 |
| Sagittula stellata E-37 | 79 | 80 |
| Roseobacter sp. AzwK-3b | 81 | 82 |
| Roseovarius sp. TM1035 | 83 | 84 |
| Oceanicola batsensis HTCC2597 | 85 | 86 |
| Oceanicola granulosus HTCC2516 | 87 | 88 |
| Rhodobacterales bacterium HTCC2150 | 89 | 90 |
| Paracoccus denitrificans PD1222 | 91 | 92 |
| Oceanibulbus indolifex HEL-45 | 93 | 94 |
| Sulfitobacter sp. EE-36 | 95 | 96 |
| Roseobacter denitrificans OCh 114 | 97 | 98 |
| Jannaschia sp. CCS1 | 99 | 100 |
| Caulobacter sp. K31 | 101 | 102 |
| Candidatus Pelagibacter ubique HTCC1062 | 103 | 104 |
| Erythrobacter litoralis HTCC2594 | 105 | 106 |
| Erythrobacter sp. NAP1 | 107 | 108 |
| Comamonas testosterone KF-1 | 109 | 110 |
| Sphingomonas wittichii RW1 | 111 | 112 |

TABLE 3-continued

SEQ ID NOs of Representative Bacterial [2Fe—2S]$^{2+}$ DHAD Proteins and Encoding Sequences

| Organism of derivation | SEQ ID NO: Nucleic Acid | SEQ ID NO: Peptide |
|---|---|---|
| Burkholderia xenovorans LB400 | 113 | 114 |
| Burkholderia phytofirmans PsJN | 115 | 116 |
| Bordetella petrii DSM 12804 | 117 | 118 |
| Bordetella bronchiseptica RB50 | 119 | 120 |
| Bradyrhizobium sp. ORS278 | 121 | 122 |
| Bradyrhizobium sp. BTAi1 | 123 | 124 |
| Bradyrhizobium japonicum | 125 | 126 |
| Sphingomonas wittichii RW1 | 127 | 128 |
| Rhodobacterales bacterium HTCC2654 | 129 | 130 |
| Solibacter usitatus Ellin6076 | 131 | 132 |
| Roseiflexus sp. RS-1 | 133 | 134 |
| Rubrobacter xylanophilus DSM 9941 | 135 | 136 |
| Salinispora tropica CNB-440 | 137 | 138 |
| Acidobacteria bacterium Ellin345 | 139 | 140 |
| Thermus thermophilus HB27 | 141 | 142 |
| Maricaulis marls MCS10 | 143 | 144 |
| Parvularcula bermudensis HTCC2503 | 145 | 146 |
| Oceanicaulis alexandrii HTCC2633 | 147 | 148 |
| Plesiocystis pacifica SIR-1 | 149 | 150 |
| Bacillus sp. NRRL B-14911 | 151 | 152 |
| Oceanobacillus iheyensis HTE831 | 153 | 154 |
| Staphylococcus saprophyticus subsp. saprophyticus ATCC 15305 | 155 | 156 |
| Bacillus selenitireducens MLS10 | 157 | 158 |
| Streptococcus pneumoniae SP6-BS73 | 159 | 160 |
| Streptococcus sanguinis SK36 | 161 | 162 |
| Streptococcus thermophilus LMG 18311 | 163 | 164 |
| Streptococcus suis 89/1591 | 165 | 166 |
| Streptococcus mutans UA159 | 167 | 168 |
| Leptospira borgpetersenii serovar Hardjo-bovis L550 | 169 | 170 |
| Candidatus Vesicomyosocius okutanii HA | 171 | 172 |
| Candidatus Ruthia magnifica str. Cm (Calyptogena magnifica) | 173 | 174 |
| Methylococcus capsulatus str. Bath | 175 | 176 |
| uncultured marine bacterium EB80_02D08 | 177 | 178 |
| uncultured marine gamma proteobacterium EBAC31A08 | 179 | 180 |
| uncultured marine gamma proteobacterium EBAC20E09 | 181 | 182 |
| uncultured gamma proteobacterium eBACHOT4E07 | 183 | 184 |
| Alcanivorax borkumensis SK2 | 185 | 186 |
| Chromohalobacter salexigens DSM 3043 | 187 | 188 |
| Marinobacter algicola DG893 | 189 | 190 |
| Marinobacter aquaeolei VT8 | 191 | 192 |
| Marinobacter sp. ELB17 | 193 | 194 |
| Pseudoalteromonas haloplanktis TAC125 | 195 | 196 |
| Acinetobacter sp. ADP1 | 197 | 198 |
| Opitutaceae bacterium TAV2 | 199 | 200 |
| Flavobacterium sp. MED217 | 201 | 202 |
| Cellulophaga sp. MED134 | 203 | 204 |
| Kordia algicida OT-1 | 205 | 206 |
| Flavobacteriales bacterium ALC-1 | 207 | 208 |
| Psychroflexus torquis ATCC 700755 | 209 | 210 |
| Flavobacteriales bacterium HTCC2170 | 211 | 212 |
| unidentified eubacterium SCB49 | 213 | 214 |
| Gramella forsetii KT0803 | 215 | 216 |
| Robiginitalea biformata HTCC2501 | 217 | 218 |
| Tenacibaculum sp. MED152 | 219 | 220 |
| Polaribacter irgensii 23-P | 221 | 222 |
| Pedobacter sp. BAL39 | 223 | 224 |
| Flavobacteria bacterium BAL38 | 225 | 226 |
| Flavobacterium psychrophilum JIP02/86 | 227 | 228 |
| Flavobacterium johnsoniae UW101 | 229 | 230 |
| Lactococcus lactis subsp. cremoris SK11 | 231 | 232 |
| Psychromonas ingrahamii 37 | 233 | 234 |
| Microscilla marina ATCC 23134 | 235 | 236 |
| Cytophaga hutchinsonii ATCC 33406 | 237 | 238 |
| Rhodopirellula baltica SH 1 | 239 | 240 |
| Blastopirellula marina DSM 3645 | 241 | 242 |
| Planctomyces maxis DSM 8797 | 243 | 244 |
| Algoriphagus sp. PR1 | 245 | 246 |

TABLE 3-continued

SEQ ID NOs of Representative Bacterial [2Fe—2S]$^{2+}$ DHAD Proteins and Encoding Sequences

| Organism of derivation | SEQ ID NO: Nucleic Acid | SEQ ID NO: Peptide |
|---|---|---|
| Candidatus Sulcia muelleri str. He (Homalodisca coagulata) | 247 | 248 |
| Candidatus Carsonella ruddii PV | 249 | 250 |
| Synechococcus sp. RS9916 | 251 | 252 |
| Synechococcus sp. WH 7803 | 253 | 254 |
| Synechococcus sp. CC9311 | 255 | 256 |
| Synechococcus sp. CC9605 | 257 | 258 |
| Synechococcus sp. WH 8102 | 259 | 260 |
| Synechococcus sp. BL107 | 261 | 262 |
| Synechococcus sp. RCC307 | 263 | 264 |
| Synechococcus sp. RS9917 | 265 | 266 |
| Synechococcus sp. WH 5701 | 267 | 268 |
| Prochlorococcus marinus str. MIT 9313 | 269 | 270 |
| Prochlorococcus marinus str. NATL2A | 271 | 272 |
| Prochlorococcus marinus str. MIT 9215 | 273 | 274 |
| Prochlorococcus marinus str. AS9601 | 275 | 276 |
| Prochlorococcus marinus str. MIT 9515 | 277 | 278 |
| Prochlorococcus marinus subsp. pastoris str. CCMP1986 | 279 | 280 |
| Prochlorococcus marinus str. MIT 9211 | 281 | 282 |
| Prochlorococcus marinus subsp. marinus str. CCMP1375 | 283 | 284 |
| Nodularia spumigena CCY9414 | 285 | 286 |
| Nostoc punctiforme PCC 73102 | 287 | 288 |
| Nostoc sp. PCC 7120 | 289 | 290 |
| Trichodesmium erythraeum IMS101 | 291 | 292 |
| Acaryochloris marina MBIC11017 | 293 | 294 |
| Lyngbya sp. PCC 8106 | 295 | 296 |
| Synechocystis sp. PCC 6803 | 297 | 298 |
| Cyanothece sp. CCY0110 | 299 | 300 |
| Thermosynechococcus elongatus BP-1 | 301 | 302 |
| Synechococcus sp. JA-2-3B'a(2-13) | 303 | 304 |
| Gloeobacter violaceus PCC 7421 | 305 | 306 |
| Nitrosomonas eutropha C91 | 307 | 308 |
| Nitrosomonas europaea ATCC 19718 | 309 | 310 |
| Nitrosospira multiformis ATCC 25196 | 311 | 312 |
| Chloroflexus aggregans DSM 9485 | 313 | 314 |
| Leptospirillum sp. Group II UBA | 315 | 316 |
| Leptospirillum sp. Group II UBA | 317 | 318 |
| Halorhodospira halophila SL1 | 319 | 320 |
| Nitrococcus mobilis Nb-231 | 321 | 322 |
| Alkalilimnicola ehrlichei MLHE-1 | 323 | 324 |
| Deinococcus geothermalis DSM 11300 | 325 | 326 |
| Polynucleobacter sp. QLW-P1DMWA-1 | 327 | 328 |
| Polynucleobacter necessarius STIR1 | 329 | 330 |
| Azoarcus sp. EbN1 | 331 | 332 |
| Burkholderia phymatum STM815 | 333 | 334 |
| Burkholderia xenovorans LB400 | 335 | 336 |
| Burkholderia multivorans ATCC 17616 | 337 | 338 |
| Burkholderia cenocepacia PC184 | 339 | 340 |
| Burkholderia mallei GB8 horse 4 | 341 | 342 |
| Ralstonia eutropha JMP134 | 343 | 344 |
| Ralstonia metallidurans CH34 | 345 | 346 |
| Ralstonia solanacearum UW551 | 347 | 348 |
| Ralstonia pickettii 12J | 349 | 350 |
| Limnobacter sp. MED105 | 351 | 352 |
| Herminiimonas arsenicoxydans | 353 | 354 |
| Bordetella parapertussis | 355 | 356 |
| Bordetella petrii DSM 12804 | 357 | 358 |
| Polaromonas sp. JS666 | 359 | 360 |
| Polaromonas naphthalenivorans CJ2 | 361 | 362 |
| Rhodoferax ferrireducens T118 | 363 | 364 |
| Verminephrobacter eiseniae EF01-2 | 365 | 366 |
| Acidovorax sp. JS42 | 367 | 368 |
| Delftia acidovorans SPH-1 | 369 | 370 |
| Methylibium petroleiphilum PM1 | 371 | 372 |
| gamma proteobacterium KT 71 | 373 | 374 |
| Tremblaya princeps | 375 | 376 |
| Blastopirellula marina DSM 3645 | 377 | 378 |
| Planctomyces maris DSM 8797 | 379 | 380 |
| Microcystis aeruginosa PCC 7806 | 381 | 382 |
| Salinibacter ruber DSM 13855 | 383 | 384 |
| Methylobacterium chloromethanicum | 385 | 386 |

TABLE 4

SEQ ID NOs of Representative Fungal and Plant [2Fe—2S]$^{2+}$ DHAD Proteins and Encoding Sequences

| Description | SEQ ID NO: Nucleic acid | SEQ ID NO: Peptide |
|---|---|---|
| Schizosaccharomyces pombe ILV3 | 387 | 388 |
| Saccharomyces cerevisiae ILV3 | 389 | 390 |
| Kluyveromyces lactis ILV3 | 391 | 392 |
| Candida albicans SC5314 ILV3 | 393 | 394 |
| Pichia stipitis CBS 6054 ILV3 | 395 | 396 |
| Yarrowia lipolytica ILV3 | 397 | 398 |
| Candida glabrata CBS 138 ILV3 | 399 | 400 |
| Chlamydomonas reinhardtii | 401 | 402 |
| Ostreococcus lucimarinus CCE9901 | 403 | 404 |
| Vitis vinifera (Unnamed protein product: CAO71581.1) | 405 | 406 |
| Vitis vinifera (Hypothetical protein: CAN67446.1) | 407 | 408 |
| Arabidopsis thaliana | 409 | 410 |
| Oryza sativa (indica cultivar-group) | 411 | 412 |
| Physcomitrella patens subsp. patens | 413 | 414 |
| Chaetomium globosum CBS 148.51 | 415 | 416 |
| Neurospora crassa OR74A | 417 | 418 |
| Magnaporthe grisea 70-15 | 419 | 420 |
| Gibberella zeae PH-1 | 421 | 422 |
| Aspergillus niger | 423 | 424 |
| Neosartorya fischeri NRRL 181 (XP_001266525.1) | 425 | 426 |
| Neosartorya fischeri NRRL 181 (XP_001262996.1) | 427 | 428 |
| Aspergillus niger (hypothetical protein An03g04520) | 429 | 430 |
| Aspergillus niger (Hypothetical protein An14g03280) | 431 | 432 |
| Aspergillus terreus NIH2624 | 433 | 434 |
| Aspergillus clavatus NRRL 1 | 435 | 436 |
| Aspergillus nidulans FGSC A4 | 437 | 438 |
| Aspergillus oryzae | 439 | 440 |
| Ajellomyces capsulatus NAm1 | 441 | 442 |
| Coccidioides immitis RS | 443 | 444 |
| Botryotinia fuckeliana B05.10 | 445 | 446 |
| Phaeosphaeria nodorum SN15 | 447 | 448 |
| Pichia guilliermondii ATCC 6260 | 449 | 450 |
| Debaryomyces hansenii CBS767 | 451 | 452 |
| Lodderomyces elongisporus NRRL YB-4239 | 453 | 454 |
| Vanderwaltozyma polyspora DSM 70294 | 455 | 456 |
| Ashbya gossypii ATCC 10895 | 457 | 458 |
| Laccaria bicolor S238N-H82 | 459 | 460 |
| Coprinopsis cinerea okayama7#130 | 461 | 462 |
| Cryptococcus neoformans var. neoformans JEC21 | 463 | 464 |
| Ustilago maydis 521 | 465 | 466 |
| Malassezia globosa CBS 7966 | 467 | 468 |
| Aspergillus clavatus NRRL 1 | 469 | 470 |
| Neosartorya fischeri NRRL 181 (Putative) | 471 | 472 |
| Aspergillus oryzae | 473 | 474 |
| Aspergillus niger (hypothetical protein An18g04160) | 475 | 476 |
| Aspergillus terreus NIH2624 | 477 | 478 |
| Coccidioides immitis RS (hypothetical protein CIMG_04591) | 479 | 480 |
| Paracoccidioides brasiliensis | 481 | 482 |
| Phaeosphaeria nodorum SN15 | 483 | 484 |
| Gibberella zeae PH-1 | 485 | 486 |
| Neurospora crassa OR74A | 487 | 488 |
| Coprinopsis cinerea okayama 7#130 | 489 | 490 |
| Laccaria bicolor S238N-H82 | 491 | 492 |
| Ustilago maydis 521 | 493 | 494 |

TABLE 5

SEQ ID NOs of Representative [4Fe—4S]$^{2+}$ DHAD Proteins and Encoding Sequences

| Organism | SEQ ID NO: Nucleic acid | SEQ ID NO: Peptide |
|---|---|---|
| *Escherichia coli* str. K-12 substr. MG1655 | 495 | 496 |
| *Bacillus subtilis* subsp. *subtilis* str. 168 | 497 | 498 |
| *Agrobacterium tumefaciens* str. C58 | 499 | 500 |
| *Burkholderia cenocepacia* MC0-3 | 501 | 502 |
| *Psychrobacter cryohalolentis* K5 | 503 | 504 |
| *Psychromonas* sp. CNPT3 | 505 | 506 |
| *Deinococcus radiodurans* R1 | 507 | 508 |
| *Wolinella succinogenes* DSM 1740 | 509 | 510 |
| *Zymomonas mobilis* subsp. *mobilis* ZM4 | 511 | 512 |
| *Clostridium acetobutylicum* ATCC 824 | 513 | 514 |
| *Clostridium beijerinckii* NCIMB 8052 | 515 | 516 |
| *Pseudomonas fluorescens* Pf-5 | 517 | 518 |
| *Methanococcus maripaludis* C7 | 519 | 520 |
| *Methanococcus aeolicus* Nankai-3 | 521 | 522 |
| *Vibrio fischeri* ATCC 700601 (ES114) | 523 | 524 |
| *Shewanella oneidensis* MR-1 ATCC 700550 | 525 | 526 |

Additional [2Fe-2S]$^{2+}$ DHADs can be identified using the analysis described in co-pending U.S. Patent Application Publication No. 2010/0081154, which is herein incorporated by reference. The analysis is as follows: A Profile Hidden Markov Model (HMM) was prepared based on amino acid sequences of eight functionally verified DHADs. These DHADs are from *Nitrosomonas europaea* (DNA SEQ ID NO:309; protein SEQ ID NO:310), *Synechocystis* sp. PCC6803 (DNA SEQ ID:297; protein SEQ ID NO:298), *Streptococcus mutans* (DNA SEQ ID NO:167; protein SEQ ID NO:168), *Streptococcus thermophilus* (DNA SEQ ID NO:163; protein SEQ ID NO:164), *Ralstonia metallidurans* (DNA SEQ ID NO:345; protein SEQ ID NO:346), *Ralstonia eutropha* (DNA SEQ ID NO:343; protein SEQ ID NO:344), and *Lactococcus lactis* (DNA SEQ ID NO:231; protein SEQ ID NO:232). In addition, the DHAD from *Flavobacterium johnsoniae* (DNA SEQ ID NO:229; protein SEQ ID NO:230) was found to have DHAD activity when expressed in *Escherichia coli* and was used in making the Profile.

The Profile HMM was built as follows:

Step 1. Build a Sequence Alignment

The eight sequences for the functionally verified DHADs listed above were aligned using Clustal W with default parameters.

Step 2. Build a Profile HMM

The hmmbuild program was run on the set of aligned sequences using default parameters. The hmmbuild reads the multiple sequence alignment file, builds a new Profile HMM, and saves the Profile HMM to file. Using this program, an un-calibrated profile was generated from the multiple alignment for each set of subunit sequences described herein.

The following information based on the HMMER software user guide gives some description of the way that the hmmbuild program prepares a Profile HMM. A Profile HMM is capable of modeling gapped alignments, for example, insertions and deletions, which allows the software to describe a complete conserved domain (rather than just a small ungapped motif). Insertions and deletions are modeled using insertion (I) states and deletion (D) states. All columns that contain more than a certain fraction x of gap characters will be assigned as an insert column. By default, x is set to 0.5. Each match state has an I and a D state associated with it. HMMER calls a group of three states (M/D/I) at the same consensus position in the alignment a "node." These states are interconnected with arrows called state transition probabilities. M and I states are emitters, while D states are silent. The transitions are arranged so that at each node, either the M state is used (and a residue is aligned and scored) or the D state is used (and no residue is aligned, resulting in a deletion-gap character, '-'). Insertions occur between nodes, and I states have a self-transition, allowing one or more inserted residues to occur between consensus columns.

The scores of residues in a match state (i.e., match state emission scores) or in an insert state (i.e., insert state emission scores) are proportional to Log_2 (p_x)/(null_x). Where p_x is the probability of an amino acid residue, at a particular position in the alignment, according to the Profile HMM and null_x is the probability according to the Null model. The Null model is a simple one state probabilistic model with pre-calculated set of emission probabilities for each of the 20 amino acids derived from the distribution of amino acids in the SWISS-PROT release 24.

State transition scores are also calculated as log odds parameters and are proportional to Log_2 (t_x). Where t_x is the probability of transiting to an emitter or non-emitter state.

Step 3. Calibrate the Profile HMM

The Profile HMM was read using hmmcalibrate which scores a large number of synthesized random sequences with the Profile (the default number of synthetic sequences used is 5,000), fits an extreme value distribution (EVD) to the histogram of those scores, and re-saves the HMM file now including the EVD parameters. These EVD parameters (μ and λ) are used to calculate the E-values of bit scores when the profile is searched against a protein sequence database hmmcalibrate writes two parameters into the HMM file on a line labeled "EVD": these parameters are the μ (location) and λ (scale) parameters of an extreme value distribution (EVD) that best fits a histogram of scores calculated on randomly generated sequences of about the same length and residue composition as SWISS-PROT. This calibration was done once for the Profile HMM.

The calibrated Profile HMM for the DHAD set of sequences is provided in Table 6 (found on pages 108-155). The Profile HMM is provided in a chart that gives the probability of each amino acid occurring at each position in the amino acid sequence. The highest probability is highlighted for each position. The first line for each position reports the match emission scores: probability for each amino acid to be in that state (highest score is highlighted). The second line reports the insert emission scores, and the third line reports on state transition scores: M→M, M→I, M→D; I→M, I→I; D→M, D→D; B→M; M→E.

For example, the DHAD Profile HMM shows that methionine has a 1757 probability of being in the first position, the highest probability which is highlighted. In the second position, glutamic acid has the highest probability, which is 1356. In the third position, lysine has the highest probability, which is 1569.

Step 4. Test the Specificity and Sensitivity of the Built Profile HMMs

The Profile HMM was evaluated using hmmsearch, which reads a Profile HMM from hmmfile and searches a sequence file for significantly similar sequence matches. The sequence file searched contained 976 sequences (see above). During the search, the size of the database (Z parameter) was set to 1 billion. This size setting ensures that significant E-values against the current database will remain significant in the foreseeable future. The E-value cutoff was set at 10.

A hmmer search with the Profile HMM generated from the alignment of the eight DHADs with experimentally verified function, matched all 976 sequences with an E value <$10^{-5}$. This result indicates that members of the dehydratase superfamily share significant sequence similarity. A hmmer search with a cutoff of E value $10^{-5}$ was used to separate DHAD related dehydratases from other more remote but related proteins, as described herein.

The Profile HMM is prepared using the HMMER software package (see Durbin, et al., Biological sequence analysis: probabilistic models of proteins and nucleic acids, Cambridge University Press, 1998; Krogh, et al., J. Mol. Biol. 235:1501-1531, 1994), following the user guide which is available from HMMER (Janelia Farm Research Campus, Ashburn, Va.). The output of the HMMER software program is a Profile Hidden Markov Model (HMM) that characterizes the input sequences. The Profile HMM prepared for the eight DHAD proteins is given in Table 6 (pages 108-155).

This Profile HMM for DHADs can be used to identify DHAD related proteins. Any protein that matches the Profile HMM with an E value of $<10^{-5}$ is a DHAD related protein, which includes $[4Fe-4S]^{2+}$ DHADs, $[2Fe-2S]^{2+}$ DHADs, aldonic acid dehydratases, and phosphogluconate dehydratases.

Sequences matching the Profile HMM given herein are then analyzed for the presence of the three conserved cysteines described herein. The exact positions of the three conserved cysteines can vary, and these can be identified in the context of the surrounding sequence using multiple sequence alignments performed with the Clustal W algorithm (Thompson, et al., Nuc. Acid Res. 22: 4673-4680, 1994) employing the following parameters: 1) for pairwise alignment parameters, a Gap opening=10; Gap extend=0.1; matrix is Gonnet 250; and mode—Slow-accurate, 2) for multiple alignment parameters, Gap opening=10; Gap extension=0.2; and matrix is Gonnet series. For example, the three conserved cysteines are located at amino acid positions 56, 129, and 201 in the *Streptococcus mutans* DHAD (SEQ ID NO:168), and at amino acid positions 61, 135, and 207 in the *Lactococcus lactis* DHAD (SEQ ID NO:232). The exact positions of the three conserved cysteines in other protein sequences correspond to these positions in the *Streptococcus mutans* or the *Lactococcus lactis* amino acid sequence. One skilled in the art will readily be able to identify the presence or absence of each of the three conserved cysteines in the amino acid sequence of a DHAD protein using pairwise or multiple sequence alignments. In addition, other methods can be used to determine the presence of the three conserved cysteines, such as by visual analysis.

The DHAD Profile HMM matching proteins that have two, but not the third (position 56) conserved cysteine, include $[4Fe-4S]^{2+}$ DHADs and phosphogluconate dehydratases (EDDs). Proteins having the three conserved cysteines include arabonate dehydratases and $[2Fe-2S]^{2+}$ DHADs, and are members of a $[2Fe-2S]^{2+}$ DHAD/aldonic acid dehydratase group. The $[2Fe-2S]^{2+}$ DHADs can be distinguished from the aldonic acid dehydratases by analyzing for signature conserved amino acids found to be present in the $[2Fe-2S]^{2+}$ DHADs or in the aldonic acid dehydratases at positions corresponding to the following positions in the *Streptococcus mutans* DHAD amino acid sequence. These signature amino acids are in $[2Fe-2S]^{2+}$ DHADs or in aldonic acid dehydratases, respectively, at the following positions (with greater than 90% occurrence): 88 asparagine vs. glutamic acid; 113 not conserved vs. glutamic acid; 142 arginine or asparagine vs. not conserved; 165 not conserved vs. glycine; 208 asparagine vs. not conserved; 454 leucine vs. not conserved; 477 phenylalanine or tyrosine vs. not conserved; and 487 glycine vs. not conserved.

The disclosed methods for identification of $[2Fe-2S]^{2+}$ DHAD enzymes can be carried out on a single sequence or on a group of sequences. In an embodiment, one or more sequence databases may be queried with a Profile HMM as described herein.

Additionally, the sequences of DHAD coding regions provided herein can be used to identify other homologs in nature. Such methods are well-known in the art, and various methods that can be used to isolate genes encoding homologous proteins are described in U.S. Patent Application Publication No. 2010/0081154, which such methods are incorporated by reference herein.

DHAD variant polypeptides provided herein may be, for example, of a size of about 10 or more, about 20 or more, about 25 or more, about 50 or more, about 75 or more, about 100 or more, about 200 or more, about 500 or more, about 1,000 or more, or about 2,000 or more amino acids. Polypeptides can have a defined three-dimensional structure, although they do not necessarily have such structure. Polypeptides with a defined three-dimensional structure are referred to as folded, and polypeptides which do not possess a defined three-dimensional structure, but rather can adopt a large number of different conformations, and are referred to as unfolded.

Also provided are active fragments of the DHAD variant polypeptides. A "fragment" is a unique portion of a polypeptide or other enzyme used in the invention which is identical in sequence to but shorter in length than the parent full-length sequence. A fragment can comprise up to the entire length of the defined sequence, minus one amino acid residue. For example, a fragment can comprise from about 5 to about 1,000 contiguous amino acid residues. A fragment can be, for example, at least 5, 10, 15, 20, 25, 30, 40, 50, 60, 75, 100, 150, 250, 500, 750, or 1,000 contiguous amino acid residues in length. Fragments can be preferentially selected from certain regions of a molecule. For example, a polypeptide fragment can comprise a certain length of contiguous amino acids selected from the first 100, 200, 300, 400, or 500 amino acids of a polypeptide as shown in a certain defined sequence. Alternatively, a polypeptide fragment can comprise a certain length of contiguous amino acids selected from the last 100, 200, 300, 400, or 500 amino acids of a polypeptide as shown in a certain defined sequence. Clearly these lengths are exemplary, and any length that is supported by the specification, including the Sequence Listing, tables, and figures, can be encompassed by the present embodiments. In certain embodiments, the DHAD variant polypeptide fragments have DHAD activity, and thus are capable of catalyzing the conversion of 2,3-dihydroxyisovalerate to α-ketoisovalerate.

DHAD Activity Assays

The presence of DHAD activity in a cell engineered to express a heterologous DHAD can be confirmed using methods known in the art and/or described herein. As one example, crude extracts from cells engineered to express a bacterial DHAD can be used in a DHAD assay as described in the Examples herein or as described by Flint and Emptage (J. Biol. Chem. 263(8): 3558-64, 1988) using dinitrophenylhydrazine. In another example, DHAD activity can be assayed by the methods disclosed in U.S. Patent Application Publication No. 2010/0081154, incorporated herein by reference, in a yeast strain that lacks endogenous DHAD activity. If DHAD activity is present, the yeast strain will grow in the absence of branched-chain amino acids. DHAD activity can also be confirmed by more indirect methods, such as by assaying for a downstream product in a pathway requiring DHAD activity. Any product that has α-ketoisovalerate or α-ketomethylvalerate as a pathway intermediate can be measured in an assay for DHAD activity. A list of such products includes, but is not limited to, valine, isoleucine, leucine, pantothenic acid, 2-methyl-1-butanol, 3-methyl-1-butanol, and isobutanol.

Nucleic Acid Molecules

Provided herein are isolated nucleic acid molecules that encode the DHAD variant polypeptides described herein. The coding region of the isolated nucleic acid encoding the DHAD variant can be codon optimized for a particular target host cell, as is well known to one skilled in the art. The isolated nucleic acid molecules of the invention can be comprised in a vector. Vectors useful for the transformation of a variety of host cells are common and commercially available from companies such as Epicentre™ (Madison, Wis.), Invitrogen Corp. (Carlsbad, Calif.), Stratagene (La Jolla, Calif.), and New England Biolabs, Inc. (Beverly, Mass.). Typically, the vector contains a selectable marker and sequences allowing autonomous replication or chromosomal integration in the desired host. In addition, suitable vectors comprise a promoter region which harbors transcriptional initiation controls and a transcriptional termination control region, between which a coding region DNA fragment can be inserted, to provide expression of the inserted coding region. Both control regions can be derived from genes homologous to the transformed host cell, although it is to be understood that such control regions can also be, for example, derived from genes that are not native to the specific species chosen as a host.

Initiation control regions or promoters, which are useful to drive expression of bacterial DHAD variant coding regions in the desired bacterial host cell, are numerous and familiar to those skilled in the art. Virtually any promoter capable of driving these genetic elements is suitable for the present invention including, but not limited to, lac, ara, tet, tip, $IP_L$, $IP_R$, T7, tac, and trc promoters (useful for expression in *Escherichia coli, Alcaligenes*, and *Pseudomonas*); the amy, apr, and npr promoters, and various phage promoters useful for expression in *Bacillus subtilis, Bacillus licheniformis*, and *Paenibacillus macerans*; nisA (useful for expression Gram-positive bacteria, Eichenbaum, et al., Appl. Environ. Microbiol. 64(8):2763-2769, 1998); and the synthetic P11 promoter (useful for expression in *Lactobacillus plantarum*, Rud, et al., Microbiology 152:1011-1019, 2006). Termination control regions can also be derived from various genes native to the preferred hosts. Optionally, a termination site can be unnecessary; however, it is most preferred if included.

Certain vectors are capable of replicating in a broad range of host bacteria and can be transferred by conjugation. The complete and annotated sequence of pRK404 and three related vectors: pRK437, pRK442, and pRK442(H), are available. These derivatives have proven to be valuable tools for genetic manipulation in Gram-negative bacteria (Scott, et al., Plasmid 50(1):74-79, 2003). Several plasmid derivatives of broad-host-range Inc P4 plasmid RSF1010 are also available with promoters that can function in a range of Gram-negative bacteria. Plasmid pAYC36 and pAYC37 have active promoters along with multiple cloning sites to allow for heterologous gene expression in Gram-negative bacteria. Some vectors that are useful for transformation of *Bacillus subtilis* and *Lactobacillus* include pAMβ1 and derivatives thereof (Renault, et al., Gene 183:175-182, 1996; and O'Sullivan, et al., Gene 137:227-231, 1993); pMBB1 and pHW800, a derivative of pMBB1 (Wyckoff, et al., Appl. Environ. Microbiol. 62:1481-1486, 1996); pMG1, a conjugative plasmid (Tanimoto, et al., J. Bacteriol. 184:5800-5804, 2002); pNZ9520 (Kleerebezem, et al., Appl. Environ. Microbiol. 63:4581-4584, 1997); pAM401 (Fujimoto, et al., Appl. Environ. Microbiol. 67:1262-1267, 2001); and pAT392 (Arthur, et al., Antimicrob. Agents Chemother. 38:1899-1903, 1994). Several plasmids from *Lactobacillus plantarum* have also been reported (van Kranenburg, et al., Appl. Environ. Microbiol. 71(3):1223-1230, 2005).

Chromosomal gene replacement tools are also widely available. For example, a thermosensitive variant of the broad-host-range replicon pWV101 has been modified to construct a plasmid pVE6002 which can be used to effect gene replacement in a range of Gram-positive bacteria (Maguin, et al., J. Bacteriol. 174(17):5633-5638, 1992). Additionally, in vitro transposomes are available from commercial sources such as Epicentre™ to create random mutations in a variety of genomes.

Vectors suitable for expression and propagation in yeast cells are also well known. Methods for gene expression in yeast are known in the art (see, e.g., Methods in Enzymology, Volume 194, Guide to Yeast Genetics and Molecular and Cell Biology (Part A, 2004, Christine Guthrie and Gerald R. Fink (Eds.), Elsevier Academic Press, San Diego, Calif.). Expression of genes in yeast typically requires a promoter, operably linked to a coding region of interest, and a transcriptional terminator. A number of yeast promoters can be used in constructing expression cassettes for genes in yeast including, but not limited to, promoters derived from the following genes: CYC1, HIS3, GAL1, GAL10, ADH1, PGK, PHOS, GAPDH, ADC1, TRP1, URA3, LEU2, ENO, TPI, CUP1, FBA, GPD, GPM, and AOX1. Suitable transcriptional terminators include, but are not limited to, FBAt, GPDt, GPMt, ERG10t, GAL1t, CYC1, and ADH1.

Suitable promoters, transcriptional terminators, and a DHAD variant coding regions can be cloned into *Escherichia coli* (*E. coli*)-yeast shuttle vectors, and transformed into yeast cells, for example. These vectors allow strain propagation in both *E. coli* and yeast strains. Typically, the vector used contains a selectable marker and sequences allowing autonomous replication or chromosomal integration in the desired host. Typically used plasmids in yeast are shuttle vectors pRS423, pRS424, pRS425, and pRS426 (American Type Culture Collection, Rockville, Md.), which contain an *E. coli* replication origin (e.g., pMB1), a yeast 2μ origin of replication, and a marker for nutritional selection. The selection markers for these four vectors are His3 (vector pRS423), Trp1 (vector pRS424), Leu2 (vector pRS425), and Ura3 (vector pRS426). Construction of expression vectors with a chimeric gene encoding the described DHAD variants can be performed, for example, by either standard molecular cloning techniques in *E. coli* or by the gap repair recombination method in yeast.

The gap repair cloning approach takes advantage of the highly efficient homologous recombination in yeast. Typically, a yeast vector DNA is digested (e.g., in its multiple cloning site) to create a "gap" in its sequence. A number of insert DNAs of interest are generated that contain a 21 bp sequence at both the 5' and the 3' ends that sequentially overlap with each other, and with the 5' and 3' terminus of the vector DNA. For example, to construct a yeast expression vector for "Gene X", a yeast promoter and a yeast terminator are selected for the expression cassette. The promoter and terminator are amplified from the yeast genomic DNA, and Gene X is either PCR amplified from its source organism or obtained from a cloning vector comprising Gene X sequence. There is at least a 21 bp overlapping sequence between the 5' end of the linearized vector and the promoter sequence, between the promoter and Gene X, between Gene X and the terminator sequence, and between the terminator and the 3' end of the linearized vector. The "gapped" vector and the insert DNAs are then co-transformed into a yeast strain and plated on the medium containing the appropriate compound mixtures that allow complementation of the nutritional selection markers on the plasmids. The presence of correct insert combinations can be confirmed by PCR mapping using plasmid DNA prepared from the selected cells. The plasmid DNA isolated from yeast (usually low in concentration) can then be transformed into an *E. coli* strain, for example, TOP10, followed by mini preps and restriction mapping to further verify the plasmid construct. Finally, the construct can be verified by sequence analysis.

Like the gap repair technique, integration into the yeast genome also takes advantage of the homologous recombination system in yeast. Typically, a cassette containing a coding region plus control elements (promoter and terminator) and auxotrophic marker is PCR-amplified with a high-fidelity DNA polymerase using primers that hybridize to the cassette and contain 40-70 base pairs of sequence homology to the regions 5' and 3' of the genomic area where insertion is desired. The PCR product is then transformed into yeast and plated on medium containing the appropriate compound mixtures that allow selection for the integrated auxotrophic marker. For example, to integrate "Gene X" into chromosomal location "Y," the promoter-coding region X-terminator construct is PCR amplified from a plasmid DNA construct and joined to an autotrophic marker (such as URA3) by either SOE PCR or by common restriction digests and cloning. The full cassette, containing the promoter-coding region X-terminator-URA3 region, is PCR amplified with primer sequences that contain 40-70 base pairs (bps) of homology to the regions 5' and 3' of location "Y" on the yeast chromosome. The PCR product is transformed into yeast and selected on growth media lacking uracil. Transformants can be verified either by colony PCR or by direct sequencing of chromosomal DNA.

Recombinant Host Cells

The isolated nucleic acid molecules and vectors of the invention can be transformed into a host cell for DHAD expression and activity. Suitable host cells include any cell capable of genetic manipulation, and include bacteria, cyanobacteria, filamentous fungi, and yeasts.

The microbial hosts selected for the production of isobutanol are preferably tolerant to isobutanol and should be able to convert carbohydrates to isobutanol. The criteria for selection of suitable microbial hosts include, for example, the following: intrinsic tolerance to isobutanol, high rate of glucose utilization, availability of genetic tools for gene manipulation, and the ability to generate stable chromosomal alterations.

Yeast Cells

Yeast cells that can be hosts for expression of a DHAD variant of the invention are any yeast cells that are amenable to genetic manipulation and include, but are not limited to, *Saccharomyces, Schizosaccharomyces, Hansenula, Candida, Kluyveromyces, Yarrowia*, and *Pichia*. Suitable strains include, but are not limited to, *Saccharomyces cerevisiae, Schizosaccharomyces pombe, Kluyveromyces lactis, Kluyveromyces thermotolerans, Candida glabrata, Candida albicans, Pichia stipitis*, and *Yarrowia lipolytica*. In some embodiments, the yeast host is *Saccharomyces cerevisiae*. *Saccharomyces cerevisiae* yeast are known in the art and are available from a variety of sources including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. *Saccharomyces cerevisiae* include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

Expression is achieved by transforming the host cell with a gene comprising a sequence encoding any of the DHAD variants of the invention. The coding region for the DHAD to be expressed can be codon optimized for the yeast cell, as is well known to one skilled in the art.

In some embodiments, reducing production of an endogenous iron-sulfur (Fe—S) protein in a yeast host cell may result in an improvement in activity of an expressed heterologous Fe—S cluster protein, such as the variant DHAD enzymes of the invention. For example, in the yeast *Saccharomyces cerevisiae*, the native DHAD is encoded by ILV3, and is a mitochondrially-localized protein. Thus, in any of the yeast hosts described herein, an endogenous ILV3 gene can be inactivated to reduce endogenous Fe—S protein expression. ILV3 encodes mitochondrial DHAD that is involved in branched chain amino acid biosynthesis. Mitochondrial DHAD is encoded by a nuclear gene, and has a mitochondrial targeting signal sequence so that it is transported to and localized in the mitochondrion. Any ILV3 gene can be inactivated in a yeast host cell of this disclosure. Examples of yeast ILV3 inactivation target genes and their encoded proteins are those from *Saccharomyces cerevisiae* YJM78 (coding SEQ ID NO:389; protein SEQ ID NO:390), *Schizosaccharomyces pombe* (coding SEQ ID NO:387; protein SEQ ID NO:3884), *Candida galbrata* strain CBS 138 (coding SEQ ID NO:399; protein SEQ ID NO:400), *Candida albicans* SC5314 (coding SEQ ID NO:393; protein SEQ ID NO:394), *Kluyveromyces lactis* (coding SEQ ID NO:391; protein SEQ ID NO:392), *Yarrowia lipolytica* (coding SEQ ID NO:397; protein SEQ ID NO:398), and *Pichia stipitis* CBS 6054 (coding SEQ ID NO:395; protein SEQ ID NO:396).

In addition, in some embodiments, over-expression of the transcriptional activator genes AFT1 and/or AFT2 or homologs thereof in a recombinant yeast microorganism improves DHAD activity. Thus, the invention also provides recombinant yeast host cells comprising the isolated nucleic acid molecules of the invention, further genetically engineered to have increased heterologous or native expression of AFT1 and/or AFT2 or homologs thereof. Grx3, Grx4, and Fra2 are proteins involved in iron-sulfur cluster biosynthesis in yeast. Grx3 and Grx4 are monothiol glutaredoxins that have been shown to be involved in cellular Fe content modulation and delivery in yeast. Glutaredoxins are glutathione-dependent thiol-disulfide oxidoreductases that function in maintaining the cellular redox homeostasis. *Saccharomyces cerevisiae* has two dithiol glutaredoxins (Grx1 and Grx2) and three monothiol glutaredoxins (Grx3, Grx4, and Grx5). The monothiol glutaredoxins are believed to reduce mixed disulfides formed between a protein and glutathione in a process known as deglutathionylation. Thus, the invention is also directed to a recombinant host described herein (e.g., yeast) further genetically modified to disrupt a gene encoding an endogenous Fra2, Grx3, and/or Grx4 or a homolog thereof. In some embodiments, increases in DHAD activity may be observed in yeast cells with disruptions in FRA2, GRX3, and/or GRX4.

In some embodiments, the invention is also directed to a recombinant host described herein (e.g., yeast) further genetically modified to disrupt (e.g., delete) a gene encoding pyruvate decarboxylase (PDC). In some embodiments, the PDC is PDC1, PDC5, PDC6, or combinations thereof.

Bacterial Cells

In some embodiments, the recombinant host cell is a prokaryotic cell. In certain embodiments, the recombinant host cell is a bacterial cell. In other embodiments, the bacterial cell is a lactic acid bacterial (LAB) cell selected from the group consisting of Lactococcus, Lactobacillus, Leuconostoc, Oenococcus, Pediococcus, and Streptococcus. In still other embodiments, the bacterial host cell is the lactic acid bacteria Lactobacillus. In some embodiments, the bacterial host cell is Lactobacillus plantarum.

Bacterial cells that can be hosts for expression of a heterologous bacterial $[2Fe-2S]^{2+}$ DHAD include, but are not limited to, Clostridium, Zymomonas, Escherichia, Salmonella, Rhodococcus, Pseudomonas, Bacillus, Lactobacillus, Enterococcus, Pediococcus, Alcaligenes, Klebsiella, Paenibacillus, Arthrobacter, Corynebacterium, Brevibacterium, Lactococcus, Leuconostoc, Oenococcus, Pediococcus, and Streptococcus. Engineering expression of a heterologous DHAD variant can increase DHAD activity in a host bacterial cell that naturally expresses a $[2Fe-2S]^{2+}$ DHAD or a $[4Fe-4S]^{2+}$ DHAD. Such host cells can include, for example, Escherichia coli and Bacillus subtilis. Furthermore, engineering expression of a heterologous DHAD variant provides DHAD activity in a host bacterial cell that has no endogenous DHAD activity. Such host cells can include, for example, Lactobacillus, Enterococcus, Pediococcus, and Leuconostoc.

Specific hosts include: Escherichia coli, Alcaligenes eutrophus, Bacillus licheniformis, Paenibacillus macerans, Rhodococcus erythropolis, Pseudomonas putida, Lactobacillus plantarum, Enterococcus faecium, Enterococcus gallinarium, Enterococcus faecalis, and Bacillus subtilis. Bacterial cells can be genetically modified for expression of DHAD variants using methods well known to one skilled in the art. Expression of DHAD variants is generally achieved by transforming suitable bacterial host cells with a sequence encoding a DHAD variant protein. Typically, the coding sequence is part of a chimeric gene used for transformation, which includes a promoter operably linked to the coding sequence as well as a ribosome binding site and a termination control region. The coding region can be from the host cell for transformation and combined with regulatory sequences that are not native to the natural gene encoding the variant DHAD. Alternatively, the coding region can be from another host cell.

Initiation control regions or promoters, which are useful to drive expression of a DHAD variant coding region in bacteria, are familiar to those skilled in the art. Some examples include the amy, apr, and npr promoters; nisA promoter (useful for expression Gram-positive bacteria (Eichenbaum, et al., Appl. Environ. Microbiol. 64(8):2763-2769, 1998); and the synthetic P11 promoter (useful for expression in Lactobacillus plantarum, Rud, et al., Microbiology 152:1011-1019, 2006). In addition, the ldhL1 and fabZ1 promoters of Lactobacillus plantarum are useful for expression of chimeric genes in bacteria. The fabZ1 promoter directs transcription of an operon with the first gene, fabZ1, encoding (3R)-hydroxymyristoyl-[acyl carrier protein] dehydratase. Termination control regions can also be derived from various genes, typically from genes native to the preferred hosts. In other embodiments, a termination site is unnecessary.

Vectors can be introduced into lactic acid bacteria (LAB) host cells using methods known in the art, such as electroporation (Cruz-Rodz, et al., Molecular Genetics and Genomics 224:1252-154, 1990; Bringel, et al., Appl. Microbiol. Biotechnol. 33:664-670, 1990; Alegre, et al., FEMS Microbiology Letters 241:73-77, 2004), and conjugation (Shrago, et al., Appl. Environ. Microbiol. 52:574-576, 1986). A chimeric DHAD gene can also be integrated into the chromosome of LAB using integration vectors (Hols, et al., Appl. Environ. Microbiol. 60:1401-1403, 1990; Jang, et al., Micro. Lett. 24:191-195, 2003).

Lactic acid bacteria are well characterized and are used commercially in a number of industrial processes. Although it is known that some lactic acid bacteria possess iron-sulfur (Fe—S) cluster requiring enzymes (Liu, et al., J. Biol. Chem. 275(17); 12367-12373, 2000) and therefore possess the genetic machinery to produce Fe—S clusters, little is known about the ability of lactic acid bacteria to insert Fe—S clusters into heterologous enzymes, and little is known about the facility with which Fe—S cluster forming proteins can be expressed in lactic acid bacteria.

To obtain high levels of product in a lactic acid bacteria from a biosynthetic pathway including DHAD activity, high expression of DHAD activity is desired. The activity of the Fe—S requiring DHAD enzyme in a host cell can be limited, for example, by the availability of Fe—S clusters in the cell. Increasing the expression of Fe—S cluster forming proteins effectively increased the activity of DHAD in LAB cells. Thus, in certain embodiments, a lactic acid bacterial host cell is genetically engineered to express at least one recombinant genetic expression element encoding Fe—S cluster forming proteins. The genetic engineering of lactic acid bacteria to express iron-sulfur cluster forming proteins is described in U.S. Patent Application Publication No. 2010/0081182, which is herein incorporated by reference.

Expression of any set of proteins for Fe—S cluster formation can be used to increase DHAD activity in LAB cells. There are three known groups of Fe—S cluster forming proteins. These proteins are encoded by three types of operons: the Suf operon, the Isc operon, and the Nif operon. U.S. Patent Application Publication No. 2010/0081182 discloses the Suf operons of Lactobacillus plantarum (L. plantarum), Lactobacillus lactis (L. lactis), and Escherichia coli (E. coli); the Isc operon of E. coli; and the Nif operon of Wolinella succinogenes.

Culture Conditions for Butanol Production

The invention also provides a method for the production of butanol (e.g., isobutanol) comprising providing recombinant host cells comprising the isolated nucleic acid molecules of the invention; culturing the recombinant host cell in a fermentation medium under suitable conditions to produce isobutanol from pyruvate; and recovering the isobutanol. In certain embodiments, the isobutanol is produced at a titer that is increased as compared to a recombinant host cell that does not contain the amino acid substitutions. In other embodiments, the isobutanol is produced at a rate that is increased by at least about 5%, at least about 10%, at least about 15%, at least about 20%, at least about 25%, at least about 30%, at least about 35%, at least about 40%, at least about 45%, at least about 50%, at least about 60%, at least about 70%, at least about 80%, at least about 90%, at least about 100%, at least about 200%, or at least about 300% as compared to a recombinant host cell that does not contain the amino acid substitutions. In other aspects of the method to produce isobutanol, the concentration of isobutanol in the fermentation medium is greater than or equal to about 10 mM, greater than or equal to about 20 mM, greater than or equal to about 30 mM, greater than or equal to about 40 mM, greater than or equal to about 50 mM, greater than or equal to about 60 mM, greater than or equal to about 70 mM, greater than or equal to about 80 mM, greater than or equal to about 90 mM, or greater than or equal to about 100 mM.

Recombinant host cells disclosed herein are grown in media which contains suitable carbon substrates. Additional carbon substrates can include, but are not limited to, monosaccharides such as fructose; oligosaccharides such as lactose, maltose, galactose, or sucrose; polysaccharides such as starch or cellulose; or mixtures thereof and unpurified mixtures from renewable feedstocks such as cheese whey permeate, cornsteep liquor, sugar beet molasses, and barley malt. Other carbon substrates can include, but are not limited to, ethanol, lactate, succinate, and glycerol.

Additionally the carbon substrate can also be one carbon substrates such as carbon dioxide, or methanol for which metabolic conversion into key biochemical intermediates has been demonstrated. In addition to one and two carbon substrates, methylotrophic organisms are also known to utilize a number of other carbon containing compounds such as methylamine, glucosamine, and a variety of amino acids for metabolic activity. For example, methylotrophic yeasts are known to utilize the carbon from methylamine to form trehalose or glycerol (Bellion, et al., Microb. Growth C1 Compd., [Int. Symp.], 7th (1993), 415 32, Editor(s): Murrell, J. Collin; Kelly, Don P. Publisher: Intercept, Andover, UK). Similarly, various species of *Candida* will metabolize alanine or oleic acid (Sulter, et al., Arch. Microbiol. 153:485 489, 1990). Hence, it is contemplated that the source of carbon utilized in the present invention can encompass a wide variety of carbon containing substrates and will only be limited by the choice of organism.

Although it is contemplated that all of the above mentioned carbon substrates and mixtures thereof are suitable in the present invention, in some embodiments, the carbon substrates may be glucose, fructose, and sucrose, or mixtures of these with five-carbon (C5) sugars such as xylose and/or arabinose for yeasts cells modified to use C5 sugars. Sucrose can be derived from renewable sugar sources such as sugar cane, sugar beets, cassava, sweet sorghum, and mixtures thereof. Glucose and dextrose can be derived from renewable grain sources through saccharification of starch based feedstocks including grains such as corn, wheat, rye, barley, oats, and mixtures thereof. In addition, fermentable sugars can be derived from renewable cellulosic or lignocellulosic biomass through processes of pretreatment and saccharification, as described, for example, in U.S. Pat. No. 7,932,063, which is herein incorporated by reference. Biomass refers to any cellulosic or lignocellulosic material and includes materials comprising cellulose, and optionally further comprising hemicellulose, lignin, starch, oligosaccharides, and/or monosaccharides. Biomass can also comprise additional components, such as protein and/or lipid. Biomass can be derived from a single source, or biomass can comprise a mixture derived from more than one source; for example, biomass can comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs, bushes, vegetables, fruits, flowers, animal manure, and mixtures thereof.

In addition to an appropriate carbon source, fermentation media may contain suitable minerals, salts, cofactors, buffers, and other components, known to those skilled in the art, suitable for the growth of the cultures and promotion of an enzymatic pathway comprising a DHAD.

Typically, cells are grown at a temperature in the range of about 20° C. to about 40° C. in an appropriate medium. Suitable growth media for the present invention include, for example, common commercially prepared media such as Luria Bertani (LB) broth, Sabouraud Dextrose (SD) broth, Yeast Medium (YM) broth, or broth that includes yeast nitrogen base, ammonium sulfate, and dextrose (as the carbon/energy source) or Yeast Extract Peptone Dextrose (YPD) Medium, a blend of peptone, yeast extract, and dextrose in optimal proportions for growing most *Saccharomyces cerevisiae* strains. Other defined or synthetic growth media can also be used, and the appropriate medium for growth of the particular microorganism will be known by one skilled in the art of microbiology or fermentation science. The use of agents known to modulate catabolite repression directly or indirectly, for example, cyclic adenosine 2':3' monophosphate, can also be incorporated into the fermentation medium.

Suitable pH ranges for the fermentation are between about pH 5.0 to about pH 9.0. In one embodiment, about pH 6.0 to about pH 8.0 is used for the initial condition. Suitable pH ranges for the fermentation of yeast are typically between about pH 3.0 to about pH 9.0. In one embodiment, about pH 5.0 to about pH 8.0 is used for the initial condition. Suitable pH ranges for the fermentation of other microorganisms are between about pH 3.0 to about pH 7.5. In one embodiment, about pH 4.5 to about pH 6.5 is used for the initial condition.

Fermentations can be performed under aerobic or anaerobic conditions. In one embodiment, anaerobic or microaerobic conditions are used for fermentations.

Industrial Batch and Continuous Fermentations

Isobutanol, or other products, can be produced using a batch method of fermentation. A classical batch fermentation is a closed system where the composition of the medium is set at the beginning of the fermentation and not subject to artificial alterations during the fermentation. A variation on the standard batch system is the fed batch system. Fed batch fermentation processes are also suitable in the present invention and comprise a typical batch system with the exception that the substrate is added in increments as the fermentation progresses. Fed batch systems are useful when catabolite repression is apt to inhibit the metabolism of the cells and where it is desirable to have limited amounts of substrate in the media. Batch and fed batch fermentations are common and well known in the art, examples of which are described by Thomas D. Brock in Biotechnology: A Textbook of Industrial Microbiology, Second Edition (1989) Sinauer Associates, Inc., Sunderland, Mass., or Deshpande, Mukund V., Appl. Biochem. Biotechnol., 36:227, (1992), herein incorporated by reference.

Isobutanol, or other products, can also be produced using continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth. Continuous fermentation allows for the modulation of one factor or any number of factors that affect cell growth or end product concentration. Methods of modulating nutrients and growth factors for continuous fermentation processes as well as techniques for maximizing the rate of product formation are well known in the art of industrial microbiology and a variety of methods are detailed by Brock, supra.

It is contemplated that the production of isobutanol, or other products, can be practiced using batch, fed batch, or continuous processes and that any known mode of fermentation is suitable. Additionally, it is contemplated that cells can be immobilized on a substrate as whole cell catalysts and subjected to fermentation conditions for isobutanol production.

Biosynthetic Pathways

Expression of a DHAD variant in bacteria or yeast, as described herein, provides the transformed, recombinant host cell with dihydroxy-acid dehydratase (DHAD) activity for conversion of 2,3-dihydroxyisovalerate to α-ketoisovalerate or 2,3-dihydroxymethylvalerate to α-ketomethylvalerate. Any product that has α-ketoisovalerate or α-ketomethylvalerate as a pathway intermediate can be produced in a bacterial or yeast strain disclosed herein having the described heterologous DHAD variants. A list of such products includes, but is not limited to, valine, isoleucine, leucine, pantothenic acid, 2-methyl-1-butanol, 3-methyl-1-butanol, and isobutanol.

For example, yeast biosynthesis of valine includes steps of acetolactate conversion to 2,3-dihydroxy-isovalerate by acetohydroxyacid reductoisomerase (ILV5), conversion of 2,3-dihydroxy-isovalerate to α-ketoisovalerate (also called 2-keto-isovalerate) by dihydroxy-acid dehydratase, and conversion of α-ketoisovalerate to valine by branched-chain amino acid transaminase (BAT2) and branched-chain amino acid aminotransferase (BAT1). Biosynthesis of leucine includes the same steps to α-ketoisovalerate, followed by conversion of α-ketoisovalerate to α-isopropylmalate by α-isopropylmalate synthase (LEU9, LEU4), conversion of α-isopropylmalate to beta-isopropylmalate by isopropylmalate isomerase (LEU1), conversion of beta-isopropylmalate to α-ketoisocaproate by beta-IPM dehydrogenase (LEU2), and finally conversion of α-ketoisocaproate to leucine by branched-chain amino acid transaminase (BAT2) and branched-chain amino acid aminotransferase (BAT1). The bacterial pathway is similar, involving differently named proteins and genes. Increased conversion of 2,3-dihydroxy-isovalerate to α-ketoisovalerate will increase flow in these pathways, particularly if one or more additional enzymes of a pathway is over-expressed. Thus, it is desired for production of valine or leucine to use a strain disclosed herein.

Biosynthesis of pantothenic acid includes a step performed by DHAD, as well as steps performed by ketopantoate hydroxymethyltransferase and pantothenate synthase. Engineering of expression of these enzymes for enhanced production of pantothenic acid biosynthesis in microorganisms is described, for example, in U.S. Pat. No. 6,177,264, which is incorporated by reference herein.

Figure 2:
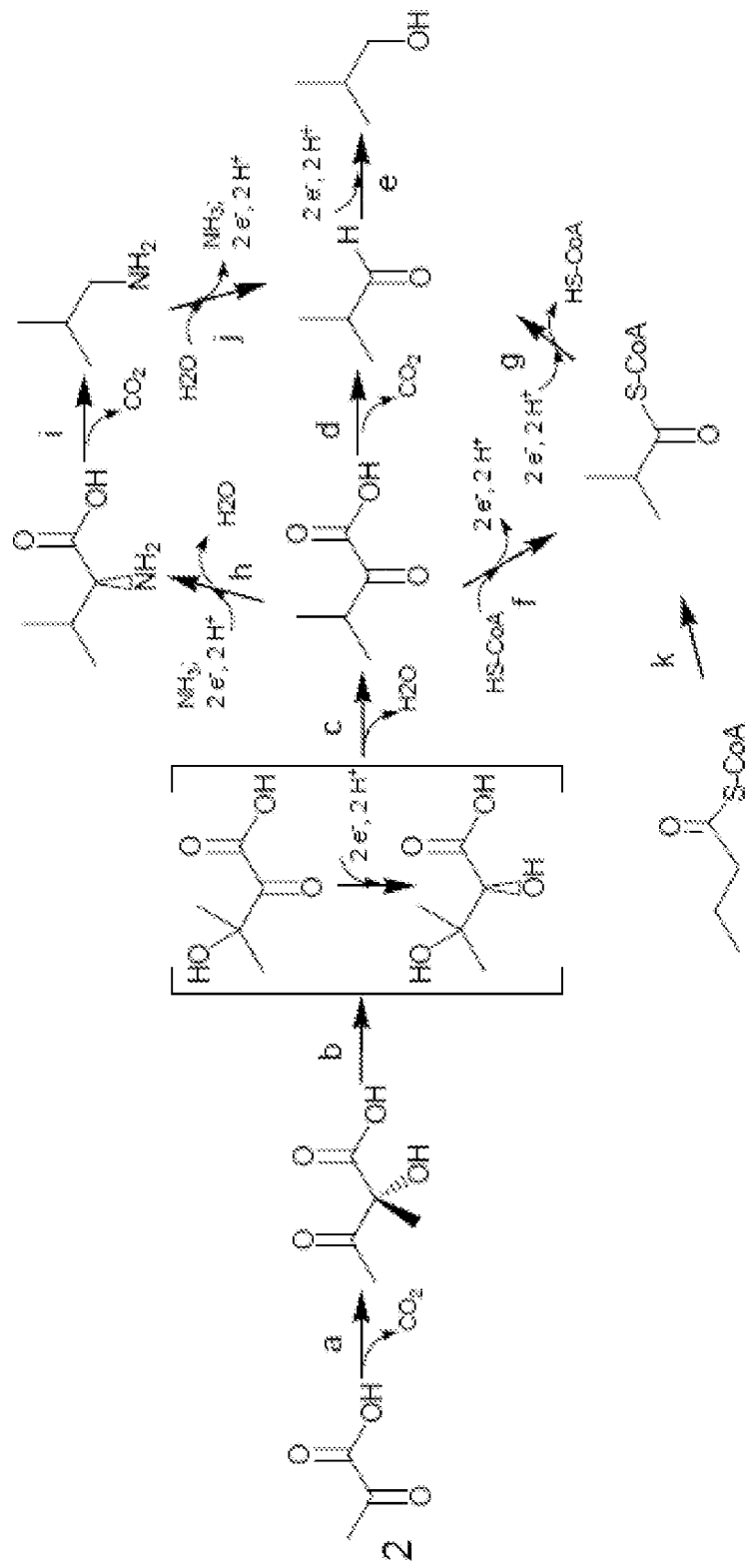
FIG. 2 shows biosynthetic pathways for isobutanol production.

The α-ketoisovalerate product of DHAD is an intermediate in isobutanol biosynthetic pathways disclosed, for example, in U.S. Pat. No. 7,851,188, which is incorporated by reference herein. A diagram of the disclosed isobutanol biosynthetic pathways is provided in FIG. 2. Production of isobutanol in a strain disclosed herein benefits from increased DHAD activity. As disclosed herein, DHAD activity is provided by expression of a variant DHAD in a bacterial or yeast cell. As described in U.S. Pat. No. 7,851,188, steps in an example isobutanol biosynthetic pathway include conversion of: pyruvate to acetolactate as catalyzed, for example, by acetolactate synthase, acetolactate to 2,3-dihydroxyisovalerate as catalyzed, for example, by acetohydroxy acid isomeroreductase; 2,3-dihydroxyisovalerate to α-ketoisovalerate as catalyzed, for example, by acetohydroxy acid dehydratase, also called dihydroxy-acid dehydratase (DHAD); α-ketoisovalerate to isobutyraldehyde as catalyzed, for example, by branched-chain α-keto acid decarboxylase; and isobutyraldehyde to isobutanol as catalyzed, for example, by branched-chain alcohol dehydrogenase. The substrate to product conversions, and enzymes involved in these reactions, are described, for example, in U.S. Pat. No. 7,851,188, which is incorporated by reference herein.

Genes that can be used for expression of the pathway step enzymes named above other than the variant DHADs disclosed herein, as well as those for two additional isobutanol pathways, are described, for example, in U.S. Pat. No. 7,851,188, which is incorporated by reference herein, and additional genes that can be used can be identified by one skilled in the art through bioinformatics or experimentally as described herein. Ketol-acid reductoisomerase (KARI) enzymes are also disclosed, for example, in U.S. Pat. No. 7,910,342 and PCT Application Publication No. WO2012/129555, both incorporated by reference herein. Examples of KARIs disclosed therein include KARIs from *Vibrio cholerae* (DNA: SEQ ID NO:599; protein SEQ ID NO:600), *Pseudomonas aeruginosa* PAO1, (DNA: SEQ ID NO:601; protein SEQ ID NO:602), *Pseudomonas fluorescens* PF5 (DNA: SEQ ID NO:603; protein SEQ ID NO:604), and *Anaerostipes caccae* (protein SEQ ID NO:605).

Additionally described in U.S. Pat. No. 7,851,188 are construction of chimeric genes and genetic engineering of bacteria and yeast for isobutanol production using the disclosed biosynthetic pathways. In some embodiments, one or more components of the biosynthetic pathways described herein can be endogenous to the host cell of choice, or can be heterologous. Additionally, in other embodiments, one or more of the genes encoding the enzymes required in the biosynthetic pathways can be over-expressed in the host cell.

Methods for Butanol Isolation from the Fermentation Medium

Methods for butanol isolation from fermentation medium have been described. For example, bioproduced isobutanol can be isolated from the fermentation medium using methods known in the art for ABE fermentations (see, e.g., Durre, Appl. Microbiol. Biotechnol. 49:639-648, 1998; Groot, et al., Process. Biochem. 27:61-75, 1992, and references therein). For example, solids may be removed from the fermentation medium by centrifugation, filtration, decantation, or the like. Then, the isobutanol can be isolated from the fermentation medium using methods such as distillation, azeotropic distillation, liquid-liquid extraction, adsorption, gas stripping, membrane evaporation, pervaporation, or combinations thereof.

Because isobutanol forms a low boiling point, azeotropic mixture with water, distillation can be used to separate the mixture up to its azeotropic composition. Distillation may be used in combination with another separation method to obtain separation around the azeotrope. Methods that can be used in combination with distillation to isolate and purify butanol include, but are not limited to, decantation, liquid-liquid extraction, adsorption, and membrane-based techniques. Additionally, butanol can be isolated using azeotropic distillation using an entrainer (see, e.g., Doherty and Malone, Conceptual Design of Distillation Systems, McGraw Hill, New York, 2001).

The butanol-water mixture forms a heterogeneous azeotrope so that distillation can be used in combination with decantation to isolate and purify the isobutanol. In this method, the isobutanol containing fermentation broth is distilled to near the azeotropic composition. Then, the azeotropic mixture is condensed, and the isobutanol is separated from the fermentation medium by decantation. The decanted aqueous phase can be returned to the first distillation column as reflux. The isobutanol-rich decanted organic phase can be further purified by distillation in a second distillation column.

The isobutanol can also be isolated from the fermentation medium using liquid-liquid extraction in combination with distillation. In this method, the isobutanol is extracted from the fermentation broth using liquid-liquid extraction with a suitable solvent. The isobutanol-containing organic phase is then distilled to separate the butanol from the solvent.

Distillation in combination with adsorption can also be used to isolate isobutanol from the fermentation medium. In this method, the fermentation broth containing the isobutanol is distilled to near the azeotropic composition and then the remaining water is removed by use of an adsorbent, such as molecular sieves (Aden, et al., Lignocellulosic Biomass to Ethanol Process Design and Economics Utilizing Co-Current Dilute Acid Prehydrolysis and Enzymatic Hydrolysis for Corn Stover, Report NREL/TP-510-32438, National Renewable Energy Laboratory, June 2002).

Additionally, distillation in combination with pervaporation may be used to isolate and purify the isobutanol from the fermentation medium. In this method, the fermentation broth containing the isobutanol is distilled to near the azeotropic composition, and then the remaining water is removed by pervaporation through a hydrophilic membrane (Guo, et al., J. Membr. Sci. 245, 199-210, 2004).

In situ product removal (ISPR) (also referred to as extractive fermentation) can be used to remove butanol (or other fermentative alcohol) from the fermentation vessel as it is produced, thereby allowing the microorganism to produce butanol at high yields. One method for ISPR for removing fermentative alcohol that has been described in the art is liquid-liquid extraction. In general, with regard to butanol fermentation, for example, the fermentation medium, which includes the microorganism, is contacted with an organic extractant at a time before the butanol concentration reaches a toxic level. The organic extractant and the fermentation medium form a biphasic mixture. The butanol partitions into the organic extractant phase, decreasing the concentration in the aqueous phase containing the microorganism, thereby limiting the exposure of the microorganism to the inhibitory butanol.

Liquid-liquid extraction can be performed, for example, according to the processes described in U.S. Patent Application Publication No. 2009/0305370, the disclosure of which is hereby incorporated in its entirety. U.S. Patent Application Publication No. 2009/0305370 describes methods for producing and recovering butanol from a fermentation broth using liquid-liquid extraction, the methods comprising the step of contacting the fermentation broth with a water immiscible extractant to form a two-phase mixture comprising an aqueous phase and an organic phase. Typically, the extractant can be an organic extractant selected from the group consisting of saturated, mono-unsaturated, poly-unsaturated (and mixtures thereof) $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof. The extractant(s) for ISPR can be non-alcohol extractants. The ISPR extractant can be an exogenous organic extractant such as oleyl alcohol, behenyl alcohol, cetyl alcohol, lauryl alcohol, myristyl alcohol, stearyl alcohol, 1-undecanol, oleic acid, lauric acid, linoleic acid, linolenic acid, myristic acid, stearic acid, methyl myristate, methyl oleate, undecanal, lauric aldehyde, 20-methylundecanal, and mixtures thereof.

In some embodiments, the alcohol can be formed by contacting the alcohol in a fermentation medium with an organic acid (e.g., fatty acids) and a catalyst capable of esterfiying the alcohol with the organic acid. In such embodiments, the organic acid can serve as an ISPR extractant into which the alcohol esters partition. The organic acid can be supplied to the fermentation vessel and/or derived from the biomass supplying fermentable carbon fed to the fermentation vessel. Lipids present in the feedstock can be catalytically hydrolyzed to organic acid, and the same catalyst (e.g., enzymes) can esterify the organic acid with the alcohol. The catalyst can be supplied to the feedstock prior to fermentation, or can be supplied to the fermentation vessel before or contemporaneously with the supplying of the feedstock. When the catalyst is supplied to the fermentation vessel, alcohol esters can be obtained by hydrolysis of the lipids forming organic acid and substantially simultaneous esterification of the organic acid with butanol present in the fermentation vessel. Organic acid and/or native oil not derived from the feedstock can also be fed to the fermentation vessel, with the native oil being hydrolyzed into organic acid. Any organic acid not esterified with the alcohol can serve as part of the ISPR extractant. The extractant containing alcohol esters can be separated from the fermentation medium, and the alcohol can be recovered from the extractant. The extractant can be recycled to the fermentation vessel. Thus, in the case of butanol production, for example, the conversion of the butanol to an ester reduces the free butanol concentration in the fermentation medium, shielding the microorganism from the toxic effect of increasing butanol concentration. In addition, unfractionated grain can be used as feedstock without separation of lipids therein, since the lipids can be catalytically hydrolyzed to organic acid, thereby decreasing the rate of build-up of lipids in the ISPR extractant.

In situ product removal can be carried out in a batch mode or a continuous mode. In a continuous mode of in situ product removal, product is continually removed from the reactor. In a batchwise mode of in situ product removal, a volume of organic extractant is added to the fermentation vessel and the extractant is not removed during the process. For in situ product removal, the organic extractant can contact the fermentation medium at the start of the fermentation forming a biphasic fermentation medium. Alternatively, the organic extractant can contact the fermentation medium after the microorganism has achieved a desired amount of growth, which can be determined by measuring the optical density of the culture. Further, the organic extractant can contact the fermentation medium at a time at which the product alcohol level in the fermentation medium reaches a preselected level. In the case of butanol production according to some embodiments of the present invention, the organic acid extractant can contact the fermentation medium at a time before the butanol concentration reaches a toxic level, so as to esterify the butanol with the organic acid to produce butanol esters and consequently reduce the concentration of butanol in the fermentation vessel. The ester-containing organic phase can then be removed from the fermentation vessel (and separated from the fermentation broth which constitutes the aqueous phase) after a desired effective titer of the butanol esters is achieved. In some embodiments, the ester-containing organic phase is separated from the aqueous phase after fermentation of the available fermentable sugar in the fermentation vessel is substantially complete.

Methods of Screening for DHAD Variants

The invention also provides yeast strains and methods of using the yeast strains to screen for DHAD variants with increased DHAD activity as compared to a parental DHAD enzyme. The premise behind the screen is to reduce DHAD expression and/or activity in a yeast strain to artificially create a system where DHAD activity is rate-limiting for growth. Introducing a mutation into the DHAD gene resulting in a DHAD variant enzyme with increased activity will overcome the rate-limiting step, allowing the strain to grow or produce an increased amount of product, such as isobutanol. Therefore, yeast isolates expressing DHAD variants with increased DHAD activity can be identified and selected based on their growth differential as compared to a control strain, or based on an increased production of a product compared to a control strain.

In certain embodiments, the invention provides a yeast strain with a defect in the genetic pathway that converts pyruvate to ethanol, such that the yeast strain cannot grow or grows poorly in fermentation medium containing glucose as the primary carbon source. The defect in the genetic pathway that converts pyruvate to ethanol can comprise a deletion of a PDC gene or a mutation in a PDC gene that reduces PDC activity. In certain embodiments, the PDC gene is PDC1, PDC5, PDC6, or a combination thereof.

The "genetic pathway that converts pyruvate to ethanol" comprises at least the following genes in *Saccharomyces cerevisiae*: PDC1, PDC5, PDC6, and ADH1. Pyruvate is first converted to acetaldehyde by pyruvate decarboxylase. Subsequently, acetaldehyde is converted to ethanol by alcohol dehydrogenase. Any defect (e.g., an insertion, deletion, mutation, or substitution in one or more pathway genes) that disrupts the ability of the yeast strain to produce ethanol from glucose but leaves intact the ability to produce isobutanol from glucose is contemplated to be a defect in the genetic pathway that converts pyruvate to ethanol.

The growth rate of the yeast strain of the invention is such that it can be modulated by increasing or decreasing the amount of DHAD activity within the cell. For example, a yeast strain of the invention that expresses very low levels of a DHAD enzyme will grow poorly or not at all when grown in fermentation medium with glucose as the primary carbon source. Thus, a "low level" of DHAD activity is defined as an amount of DHAD enzyme activity that results in no growth or poor growth of the yeast strain of the invention. "Poor growth," for the purposes of the present invention, can be considered a growth rate that is slow enough that a detectable difference in growth rates can be observed when DHAD activity is restored. Conversely, a yeast strain of the invention that expresses high levels of DHAD enzyme will grow well when grown in fermentation medium with glucose as the primary carbon source. As such, a "high level" of DHAD activity is defined as an amount of DHAD enzyme activity that results in a growth rate that is detectably improved compared to the same strain expressing a low level of DHAD activity. The growth differential between a strain with low levels of DHAD activity and a strain with high levels of DHAD activity can be determined or detected by methods known to a skilled artisan, such as calculating doubling times, determining the density of cells in culture, or simply by visually assessing the size of individual colonies grown on solid media after a given amount of time.

Numerous methods can be used to modulate the expression levels of a DHAD enzyme in the yeast strain of the invention and are well known to skilled artisans. These methods include, but are not limited to, expressing a DHAD enzyme under a weak promoter, expressing a DHAD enzyme on a low copy number plasmid, expressing a DHAD enzyme under an inducible promoter and varying the amount of inducing agent, optimizing codon usage for the organism in which it is to be expressed (to increase expression) or adjusting codon usage to be sub-optimal for the organism in which it is to be expressed (to decrease expression).

Low copy number plasmids generally exist in a cell in less than about 100 copies/cell. In certain embodiments, the low copy number plasmid exists in a cell in less than about 50, less than about 40, less than about 30, less than about 20, less than about 10, less than about 5, or less than about 2 copies/cell. In certain embodiments, the low copy number plasmid exists in a cell in about one copy per cell.

In methods to screen for DHAD variants, the yeast strain of the invention is transformed with a polynucleotide comprising a nucleic acid sequence encoding a parental DHAD enzyme under conditions wherein a low level of DHAD enzyme activity is achieved, and no growth or poor growth of the strain is seen in fermentation medium wherein glucose is the primary carbon source. This transformant is used as a control strain. A library of polynucleotides is prepared, each polynucleotide comprising a nucleic acid sequence encoding a DHAD variant. This library of DHAD variants is transformed into the yeast strain of the invention, under the same conditions as the control strain, and growth rates or product yield of individual isolates transformed with a variant is assessed. Variants that result in increased DHAD activity will grow more robustly and/or produce a higher yield of product than the control strain, and can be isolated for further analysis.

Thus, an aspect of the invention is directed to a method of screening DHAD protein variants, comprising: (a) providing a yeast strain with a defect in a genetic pathway that converts pyruvate to ethanol, wherein the yeast strain cannot grow or grows poorly in fermentation medium containing glucose as the primary carbon source; (b) transforming the yeast strain with a library of polynucleotides, each polynucleotide comprising a nucleic acid sequence encoding a DHAD variant, wherein: (i) the nucleic acid sequence encoding the DHAD variant is operably linked to a weak promoter; or (ii) the nucleic acid sequence encoding the DHAD variant is comprised within a low copy number plasmid; wherein the yeast strain cannot grow or grows poorly when transformed with a control polynucleotide comprising a nucleic acid sequence encoding a wild type DHAD, operably linked to the weak promoter or transformed with a control low copy number plasmid comprising a nucleic acid sequence encoding a wild type DHAD; and (c) selecting transformants with improved growth compared to growth of a strain transformed with the control polynucleotide. In some embodiments, the defect in the genetic pathway that converts pyruvate to ethanol comprises a deletion of a pyruvate decarboxylase (PDC) gene. In other embodiments, the defect in the genetic pathway that converts pyruvate to ethanol comprises a mutation in a PDC gene that reduces PDC activity. In certain embodiments, the PDC gene is PDC1, PDC5, PDC6, or a combination thereof.

In some embodiments of the method of screening DHAD protein variants, the weak promoter is a truncated Leu2 promoter. In certain embodiments, the truncated Leu2 promoter is SEQ ID NO:545. In other embodiments of the method of screening DHAD protein variants, the weak promoter is a truncated FBA promoter. In certain embodiments, the truncated FBA promoter is SEQ ID NO:546. Other weak promoters are known in the art, such as the Ste5 promoter, the Ura3 promoter, and the Cyc1 promoter. Other promoters that are considered strong or moderate promoters in their full-length state can be made weak by truncation or other modifications. For the purposes of the present invention, a "weak promoter" is defined as a promoter that results in a level of expression of a parental DHAD enzyme in a strain of the invention that does not allow growth or allows only poor growth on fermentation medium with glucose as the primary carbon source.

In some embodiments of the method of screening DHAD protein variants, the low copy number plasmid has a copy number of one or two in yeast. In certain embodiments, the low copy number plasmid is pRS413. Low copy number plasmids for use in yeast include the yeast integrating plasmids (Yip) and yeast centromere plasmids (YCp), as well as the pRS series of plasmids. pRS plasmids were first described by Sikorski, et al. (Genetics, 122:19-27, 1989) and include, but are not limited to, pRS303, pRS304, pRS305, pRS306, pRS313, pRS314, pRS315, and pRS316.

In other embodiments of the method of screening DHAD protein variants, the growth of the strain is under oxygen limiting conditions. In yet other embodiments, the yeast strain is further transformed with genes encoding acetolactate synthase, acetohydroxy acid isomeroreductase, α-keto acid decarboxylase, and alcohol dehydrogenase. In certain embodiments of the method of screening DHAD protein variants, the method further comprises determining the rate of isobutanol production of the transformants.

Another aspect of the invention is directed to isolated polynucleotides comprising a nucleic acid sequence encoding a DHAD variant obtained by the method of screening DHAD protein variants as described herein. The invention is also directed to isolated DHAD variant polypeptides encoded by these nucleic acid sequences.

EXAMPLES

Example 1

Construction of Yeast Strain PNY2204

The purpose of this example is to describe construction of a vector to enable integration of a gene encoding acetolactate synthase into the naturally occurring intergenic region between the PDC1 and TRX1 coding sequences in Chromosome XII. Construction of yeast strain PNY2204 is also described, for example, in U.S. Application Publication No. 2012/0237988, which is incorporated herein by reference.
Construction of Integration Vector pUC19-Kan::Pdc1::FBA-alsS::TRX1

Figure 3:
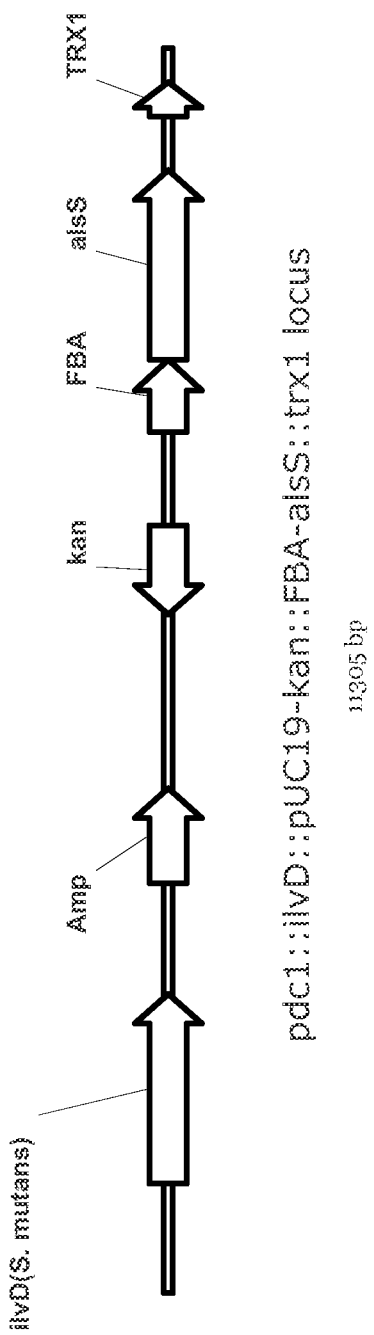
FIG. 3 is a schematic diagram of the PNY2204 locus (pdc1Δ::ilvD::pUC19-kan::FBA-alsS::TRX1).

The FBA-alsS-CYCt cassette was constructed by moving the 1.7 kb BbvCI/PacI fragment from pRS426::GPD::alsS::CYC (U.S. Appl. Pub. No. 2007/0092957, incorporated by reference) to pRS426::FBA::ILVS::CYC (U.S. Application Publication No. 2007/0092957, incorporated by reference, previously digested with BbvCI/PacI to release the ILV5 gene). Ligation reactions were transformed into E. coli TOP10 cells and transformants were screened by PCR using primers N98SeqF1 (SEQ ID NO:580) and N99SeqR2 (SEQ ID NO:581). The FBA-alsS-CYCt cassette was isolated from the vector using BglII and NotI for cloning into pUC19-URA3::ilvD-TRX1 (as described in U.S. Application Publication No. 2012/0156735, incorporated herein by reference, clone "B;" herein SEQ ID NO:582) at the AflII site (Klenow fragment was used to make ends compatible for ligation). Transformants containing the alsS cassette in both orientations in the vector were obtained and confirmed by PCR using primers N98SeqF4 (SEQ ID NO:583) and N1111 (SEQ ID NO:584) for configuration "A" and N98SeqF4 (SEQ ID NO:583) and N1110 (SEQ ID NO:585) for configuration "B." A geneticin selectable version of the "A" configuration vector was then made by removing the URA3 gene (1.2 kb NotI/NaeI fragment) and adding a geneticin cassette (SEQ ID NO:586 herein; previously described in U.S. Application Publication No. 2012/0156735, incorporated herein by reference) maintained in a pUC19 vector (cloned at the SmaI site). The kan gene was isolated from pUC19 by first digesting with KpnI, removal of 3' overhanging DNA using Klenow fragment (New England BioLabs, Inc., Ipswich, Mass.; Cat. No. M212), digesting with HincII, and then gel purifying the 1.8 kb gene fragment (Zymoclean™ Gel DNA Recovery Kit, Cat. No. D4001, Zymo Research, Orange, Calif.; SEQ ID NO:587). Klenow fragment was used to make all ends compatible for ligation, and transformants were screened by PCR to select a clone with the geneticin resistance gene in the same orientation as the previous URA3 marker using primers BK468 (SEQ ID NO:588) and N160SeqF5 (SEQ ID NO:589). The resulting clone was called pUC19-kan::pdc1::FBA-alsS::TRX1 (clone A) (SEQ ID NO:590).
Construction of alsS Integrant Strains and Isobutanol-Producing Derivatives The pUC19-kan::pdc1::FBA-alsS integration vector described above was linearized with PmeI and transformed into PNY1507 (described, for example, in U.S. Application Publication No. 2012/0156735, incorporated herein by reference). PmeI cuts the vector within the cloned pdc1-TRX1 intergenic region and thus leads to targeted integration at that location (Rothstein, Methods in Enzymology, 1991, volume 194, pp. 281-301). Transformants were selected on YPE plus 50 μg/ml G418. Patched transformants were screened by PCR for the integration event using primers N160SeqF5 (SEQ ID NO:589) and oBP512 (SEQ ID NO:591). Two transformants were tested indirectly for acetolactate synthase function by evaluating the strains ability to make isobutanol. To do this, additional isobutanol pathway genes were supplied on E. coli-yeast shuttle vectors (pYZ090ΔalsS and pBP915, described below). One clone, strain MATa ura3Δ::loxP his3Δpdc6Δpdc1Δ::P[PDC1]-DHAD|ilvD_Sm-PDC1t-pUC19-loxP-kanMX-loxP-P[FBA1]-ALS|alsS_Bs-CYC1t pdc5Δ::P[PDC5]-ADH|sadB_Ax-PDC5t gpd2Δ::loxP fra2Δadh1Δ::UAS(PGK1)P[FBA1]-kivD_L1(y)-ADH1t was designated as PNY2204. The plasmid-free parent strain was designated PNY2204. The PNY2204 locus (pdc1Δ::ilvD::pUC19-kan::FBA-alsS::TRX1) is depicted in FIG. 3.
Isobutanol Pathway Plasmids (pYZ090ΔalsS and pBP915)

pYZ090 (SEQ ID NO:592) was digested with SpeI and NotI to remove most of the CUP1 promoter and all of the alsS coding sequence and CYC terminator. The vector was then self-ligated after treatment with Klenow fragment and transformed into E. coli Stb13 cells, selecting for ampicillin resistance. Removal of the DNA region was confirmed for two independent clones by DNA sequencing across the ligation junction by PCR using primer N191 (SEQ ID NO:593). The resulting plasmid was named pYZ090ΔalsS (SEQ ID NO:594).

pBP915 was constructed from pLH468 (SEQ ID NO:595) by deleting the kivD gene and 957 base pairs of the TDH3 promoter upstream of kivD. pLH468 was digested with SwaI and the large fragment (12,896 bp) was purified on an agarose gel followed by a Gel Extraction kit (Qiagen, Valencia, Calif.). The isolated fragment of DNA was self-ligated with T4 DNA ligase and used to transform electrocompetent TOP10 *E. coli* (Invitrogen; Carlsbad, Calif.). Plasmids from transformants were isolated and checked for the proper deletion by restriction analysis with the SwaI restriction enzyme. Isolates were also sequenced across the deletion site with primers oBP556 (SEQ ID NO:596) and oBP561 (SEQ ID NO:597). A clone with the proper deletion was designated pBP915 (pLH468AkivD) (SEQ ID NO:598).

Example 2

Expression of DHAD with a Weak Promoter for Isobutanol Production in Yeast

The use of dihydroxy-acid dehydratase (DHAD) enzymes, such as IlvD from *Streptococcus mutans*, for isobutanol production in yeast has been previously described, for example, in U.S. Application Publication No. 2012/0237988, incorporated herein by reference. In this example, yeast strain PNY2204 [MATa ura3Δ::loxP his3Δ pdc6Δ pdc1Δ::P[PDC1]-DHAD|ilvD_Sm-PDC1t-pUC19-loxP-kanMX-loxP-P [FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_L1(y)-ADH1t, described above] was used as a starting point to determine the growth rate and isobutanol production rate of a strain with low levels of DHAD expression.

First, to create a control strain, yeast strain PNY2204 was transformed with plasmid pHR81 Ilv5p-K9G9 containing a KARI variant (SEQ ID NO:577). Transformants were selected on SE (-Ura) plates. The resulting strain was designated as PNY2204(K9G9). Next, plasmid pRS423 FBAp-IlvD(sm) GPMp-ADH (SEQ ID NO:578) was transformed into strain PNY2204 (K9G9) to complete the isobutanol pathway. On the plasmid pRS423 FBAp-IlvD(sm) GPMp-ADH, the DHAD gene is under the control of a strong FBA promoter. In addition, this plasmid also contained an additional ADH gene under the control of the GPM promoter to ensure a high level of activity for the downstream isobutanol pathway. Transformants were selected on agar plates with SE (-Ura -His) medium. This strain grew well on 2% glucose and produced significant amounts of isobutanol.

To create a strain with low levels of DHAD expression, strain PNY2204 (K9G9) was transformed with plasmid pRS423 Leu2p(75)-IlvD(Sm) GPMp-ADH (SEQ ID NO:579). This plasmid is identical to plasmid pRS423 FBAp-IlvD(sm) GPMp-ADH, described above, however the DHAD gene is under the control of a weak, truncated Leu2 promoter containing only 75 base pairs upstream of the ATG start site of the Leu2 coding region (SEQ ID NO:575). Transformants were selected on SE (-Ura -His) medium. The transformants obtained grew poorly on 2% glucose and made less isobutanol (lower titer) as compared to the strains containing plasmid pRS423 FBAp-IlvD(sm). This result indicated that a rate-limiting step for DHAD activity had been established using the truncated Leu2 promoter for expression.

Example 3

Construction and Screening of DHAD Mutant Libraries

Typically, pyruvate decarboxylase (PDC) deletion strains have reduced growth in the presence of 2% glucose in growth medium, especially under oxygen-limiting conditions. However, the introduction of an isobutanol pathway often results in increased growth. As shown in Example 2, DHAD enzyme activity is a rate-limiting step in the isobutanol pathway in strain PNY2204(K9G9) or PNY2204 (K9D3). One way to overcome this rate-limiting step is to improve the DHAD activity through mutagenesis of its gene ilvD. Better growth and increased isobutanol production can thus be used to screen for strains with higher DHAD activity.

Mutagenesis of the ilvD gene was carried out with the GeneMorph II Random Mutagenesis kit (Agilent Technologies, Santa Clara, Calif.). Randomly mutagenized PCR product was ligated into the pRS423 Leu2p(75) vector (SEQ ID NO:579) using the restriction sites SpeI and NotI. The ligation mixture was transformed into *E. coli*. Transformants were spread onto large LB plates (22 cm×23 cm) supplemented with 100 μg/ml of ampicillin. About 200,000 to 300,000 colonies were obtained per plate. Colonies were scraped from the plates, and aliquots of cell suspensions were taken for plasmid preparation. The library of randomly mutagenized pRS423 Leu2p(75) plasmids was transformed into PNY2204(K9G9) yeast strain. The transformation mixture was spread onto SE (-His, -Ura) plates to obtain about 7,000 colony forming units (CFUs) per plate. When colonies were visible following incubation, cells were scraped off the plates into SE broth. The yeast cells were allowed to grow in serum bottles containing SD liquid medium (2% glucose, -His, -Ura). After three days, 10 ml of the culture was transferred into new serum bottles with fresh SD medium to enrich the population that can grow on 2% glucose. Three passages later, an aliquot of culture was spread onto plates with YPDE medium (YPD with 0.1% ethanol) and were allowed to grow under anaerobic conditions to select individual colonies. Colonies that grew well were selected and patched onto YPDE plates. Plasmids from these strains were isolated with a yeast plasmid isolation kit (Zymoprep II Yeast Plasmid Mini Prep, Zymo Research, Orange, Calif.) and transformed into *E. coli* for plasmid isolation. The ilvD genes on the plasmids were sequenced to determine the sites of any mutations.

As described above, strains containing a wild type DHAD enzyme from *Streptococcus mutans* under the control of a truncated Leu2 promoter grew poorly in medium containing 2% glucose. It was expected that strains that grew well under anaerobic conditions would contain DHAD enzymes with mutations that result in increased activity. Sequencing of the mutant plasmids obtained from the above-described screen resulted in 15 DHAD variants, listed in Table 7:

TABLE 7

*Streptococcus mutans* DHAD Variants

| Variant No | Substitution | Amino Acid SEQ ID NO |
|---|---|---|
| 1 | K564E | 528 |
| 2 | D62E, F562V | 532 |
| 3 | G33D, W563R | 534 |
| 4 | F562V | 537 |
| 5 | W563R | 540 |
| 6 | W563C | 545 |
| 7 | E524G, W563G | 548 |
| 8 | M115V, G158R, E567D | 552 |
| 9 | G116E, N119S | 555 |
| 10 | G33D | 557 |
| 11 | D62E | 561 |
| 12 | F562L | 563 |
| 13 | H176Q, H179L, Q322R, W563R | 566 |
| 14 | A425S, W563R | 569 |
| 15 | W563G | 572 |

Many of the variants were isolated multiple times from the screen. In addition to the mutations leading to the amino acid substitutions listed in Table 7, many of the isolates also contained silent mutations. DHAD variants, the number of isolates obtained of each variant, the locations of the silent mutations in each isolate, as well as the isobutanol titer obtained from each isolate are listed in Table 8:

TABLE 8

Isolates of each *Streptococcus mutans* DHAD Variant

| Variant No. | Substitution | Isolate | Silent Mutation Locations | Nucleic Acid SEQ ID NO | Isobutanol (mM) |
|---|---|---|---|---|---|
| 1 | K564E | A | | 527 | |
| | | B | D257, R407 | 529 | 43.2 |
| | | C | G368 | 530 | 47.6 |
| 2 | D62E, F562V | A | | 531 | 42.8 |
| 3 | G33D, W563R | A | | 533 | |
| | | B | G218, K314, G557 | 535 | 46.3 |
| | | C | G218, K314, G557 | 535 | 48.4 |
| | | D | G218, K314, G557 | 535 | 42.4 |
| 4 | F562V | A | | 536 | |
| | | B | G199 | 538 | |
| 5 | W563R | A | | 539 | 41.2 |
| | | B | | 606 | 39.0 |
| | | C | L343 | 541 | 43.8 |
| | | D | G93, I155, D511 | 542 | 43.2 |
| | | E | G93, I155, D511 | 542 | 47.2 |
| | | F | R13, V486 | 543 | 42.9 |
| | | G | R13, V486 | 543 | 40.0 |
| | | H | R13, V486 | 543 | 30.7 |
| | | I | R13, V486 | 543 | 39.3 |
| 6 | W563C | A | | 544 | |
| | | B | G70, D395 | 546 | 45.5 |
| | | C | G70, D395 | 546 | |
| 7 | E524G, W563G | A | | 547 | |
| | | B | L253, A397 | 549 | 38.1 |
| | | C | A397 | 550 | |
| 8 | M115V, G158R, E567D | A | | 551 | |
| | | B | T49, P308 | 553 | 43.3 |
| 9 | G116E, N119S | A | | 554 | 38.0 |
| 10 | G33D | A | | 556 | |
| | | B | G218 | 558 | 44.4 |
| | | C | G218, K314, G557 | 559 | 41.2 |
| | | D | G218 | 558 | 42.9 |
| 11 | D62E | A | | 560 | |
| 12 | F562L | A | | 562 | |
| | | B | P134 | 564 | 38.5 |
| 13 | H176Q, H179L, Q322R, W563R | A | | 565 | |
| | | B | Q369, V436 | 567 | |
| 14 | A425S, W563R | A | | 568 | |
| | | B | A490 | 570 | |

TABLE 8-continued

Isolates of each *Streptococcus mutans* DHAD Variant

| Variant No. | Substitution | Isolate | Silent Mutation Locations | Nucleic Acid SEQ ID NO | Isobutanol (mM) |
|---|---|---|---|---|---|
| 15 | W563G | A | | 571 | |
| | | B | | 571 | |
| | | C | | 571 | |
| Control | Wild type | | | 167 | 20 |

Common mutations were clustered around the amino acids at the 562, 563, 564 positions near the C-terminus Numerous isolates with substitutions at Trp-563 were obtained. As shown in Table 8, these results suggest that the mutations obtained in these amino acids improve DHAD function and therefore, result in increased growth on 2% glucose and increased isobutanol production. When isobutanol production was measured, the titer in these strains doubled as compared to the strain with the wild type DHAD under the truncated Leu2 promoter ("Control" in Table 8). The results obtained here successfully demonstrated the utility of a screening method employed for identification of desirable mutations in the DHAD enzyme.

Two isolates were obtained that had increased growth on 2% glucose and increased isobutanol production, but did not contain an amino acid substitution. However, both of these isolates contained silent mutations. The nucleic acid sequence of the first of these isolates is represented by SEQ ID NO:573. This *Streptococcus mutans* ilvD isolate has a silent mutation at proline 228 (CCG to CCA), and resulted in an isobutanol titer of 46.8 mM. The nucleic acid sequence of the second of these isolates is represented by SEQ ID NO:574. This *Streptococcus mutans* ilvD isolate has a silent mutation at glycine 93 (GGA to GGT), isoleucine 155 (ATT to ATC), and aspartic acid 511 (GAC to GAT), and resulted in an isobutanol titer of 47.0 mM.

While various embodiments of the present invention have been described above, it should be understood that they have been presented by way of example only, and not limitation. It will be apparent to persons skilled in the relevant art that various changes in form and detail can be made therein without departing from the spirit and scope of the invention. Thus, the breadth and scope of the present invention should not be limited by any of the above-described exemplary embodiments, but should be defined only in accordance with the following claims and their equivalents.

All publications, patents and patent applications mentioned in this specification are indicative of the level of skill of those skilled in the art to which this invention pertains, and are herein incorporated by reference to the same extent as if each individual publication, patent or patent application was specifically and individually indicated to be incorporated by reference.

TABLE 6

| | | | | | | | | | | | | | | |
|---|---|---|---|---|---|---|---|---|---|---|---|---|---|---|
| HMMER2.0 [2.2 g] | | | | | | | | | Program name and version | | | | | |
| NAME dhad_for_hmm | | | | | | | | | Name of the input sequence alignment file | | | | | |
| LENG 564 | | | | | | | | | Length of the alignment: include indels | | | | | |
| ALPH Amino | | | | | | | | | Type of residues | | | | | |
| MAP yes | | | | | | | | | Map of the match states to the columns of the alignment | | | | | |
| COM /app/public/hmmer/current/bin/hmmbuild -F dhad-exp_hmm dhad_for_hmm.aln | | | | | | | | | Commands used to generate the file: this one means that hmmbuild (default parameters) was applied to the alignment file | | | | | |
| COM /app/public/hmmer/current/bin/hmmcalibrate dhad-exp_hmm | | | | | | | | | Commands used to generate the file: this one means that hmmcalibrate (default parameters) was applied to the hmm profile | | | | | |
| NSEQ 8 | | | | | | | | | Number of sequences in the alignment file | | | | | |
| DATE Tue Jun 3 10:44:24 2008 | | | | | | | | | When was the file generated | | | | | |
| XT -8455 -4 -1000 -1000 -8455 -4 -8455 -4 | | | | | | | | | | | | | | |
| NULT -4 -8455 | | | | | | | | | The transition probability distribution for the null model | | | | | |
| NULE 595 -1558 85 338 -294 453 -1158 197 249 902 -1085 -142 -21 -313 45 531 201 384 -1998 | | | | | | | | | probability used to convert these back to model probabilities is 1/K. | | | | | |
| | | | | | | | | | The symbol emission probability distribution for the null model (G state); consists of K (e.g. 4 or 20) integers. The null | | | | | |
| EVD -499.650970 0.086142 | | | | | | | | | The extreme value distribution parameters μ and lambda respectively; both floating point values. Lambda is positive and nonzero. These values are set when the model is calibrated with hmmcalibrate. | | | | | |

| HMM | A | C | D | E | F | G | H | I | K | L | M | N | P | Q | R | S | T | V | W | Y | Position in alignment |
|---|---|---|---|---|---|---|---|---|---|---|---|---|---|---|---|---|---|---|---|---|---|
| | m->m | m->i | m->d | i->m | i->i | d->m | d->d | b->m | m->e | | | | | | | | | | | | |
| | -538 | * | -1684 | | | | | | | | | | | | | | | | | | |
| 1(M) | -233 | -1296 | 99 | 1223 | -1477 | -1132 | 89 | -1122 | 420 | -1248 | 1757 | 1553 | -1296 | 464 | -24 | -190 | -188 | -838 | -1578 | -985 | 6 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -29 | -6203 | -7245 | -894 | -1115 | -701 | -1378 | -538 | * | | | | | | | | | | | | |
| 2(E) | -220 | -1288 | 232 | 1356 | -1807 | 1016 | -70 | -1474 | 190 | -1584 | -775 | 132 | -1298 | 300 | -282 | -183 | 1140 | -1092 | -1872 | -1262 | 7 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -29 | -6203 | -7245 | -894 | -1115 | -701 | -1378 | * | * | | | | | | | | | | | | |
| 3(K) | 448 | -1932 | 1558 | 658 | -2220 | -1048 | 40 | -1983 | 1569 | -1938 | -1091 | 1558 | -1319 | 450 | -193 | -278 | -419 | -1552 | -2121 | -1397 | 8 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -29 | -6203 | -7245 | -894 | -1115 | -701 | -1378 | * | * | | | | | | | | | | | | |
| 4(V) | -404 | -498 | -1497 | -939 | -588 | -1810 | -640 | 1591 | 914 | -127 | 335 | -962 | -1866 | -562 | -767 | -868 | -357 | 720 | -1169 | -763 | 9 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -29 | -6203 | -7245 | -894 | -1115 | -701 | -1378 | * | * | | | | | | | | | | | | |
| 5(E) | -265 | -1340 | -52 | 1376 | -1572 | -1189 | 113 | -1125 | 1345 | -1287 | -496 | 99 | -1321 | 505 | 198 | -218 | -205 | 597 | -1598 | -1032 | 10 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -29 | -6203 | -7245 | -894 | -1115 | -701 | -1378 | * | * | | | | | | | | | | | | |
| 6(S) | 256 | -397 | -1014 | -830 | -1841 | -646 | -862 | -1443 | -767 | -1740 | -963 | -568 | -1249 | -651 | -1007 | 2367 | 1586 | -862 | -2080 | -1672 | 11 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -29 | -6203 | -7245 | -894 | -1115 | -701 | -1378 | * | * | | | | | | | | | | | | |
| 7(M) | -990 | -889 | -2630 | 157 | -513 | -2514 | -1346 | 1309 | -1767 | 820 | 3683 | -1898 | -2491 | -1496 | -1779 | -1589 | -925 | 150 | -1336 | -1041 | 12 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | | |
|---|---|---|---|---|---|---|---|---|---|---|---|---|---|---|---|---|---|---|---|
| 8(E) | 588 | -1875 | -194 | 1536 | -2188 | -1373 | -59 | -1931 | 957 | -1890 | -977 | 904 | 292 | 393 | -162 | 438 | -372 | -1495 | -2070 | -1391 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 9(N) | -514 | -1116 | 1207 | -315 | 447 | -1650 | -304 | -778 | -224 | 825 | -277 | 1457 | -1738 | -123 | -618 | -627 | -454 | -603 | -1186 | 763 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 10(N) | -815 | -1190 | -1360 | -922 | -904 | -1967 | -797 | -442 | -670 | 381 | 1700 | 3009 | -2099 | -654 | -934 | -1051 | -791 | -445 | -1490 | -979 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 11(K) | -1530 | -2498 | -1722 | -855 | -3141 | -2246 | -428 | -2627 | 2828 | -2404 | -1656 | -927 | 662 | -2 | 2047 | -1421 | -1337 | -2324 | -2357 | -2081 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 12(Y) | -872 | -1887 | -861 | -290 | -1369 | -1801 | 1662 | -1797 | 325 | -1793 | -1031 | 893 | -1876 | 56 | 2219 | -812 | -780 | -1514 | -1565 | -2287 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 13(S) | -830 | -1586 | -1471 | -1099 | -2717 | -1642 | -1010 | -2479 | -266 | -2518 | -1746 | -1065 | -2069 | -676 | 1822 | -2748 | -1000 | -1950 | -2597 | -2189 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 14(Q) | -851 | -2131 | -755 | -153 | -2554 | -1735 | -211 | -2205 | 1908 | -2094 | -1244 | -386 | -1802 | 2254 | 974 | 1001 | -747 | -1819 | -2181 | -1667 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 15(T) | -405 | -1258 | -618 | -100 | -1490 | -1466 | 1158 | -1121 | 1 | -1299 | -514 | 578 | -1607 | 65 | -433 | 960 | 1849 | 343 | -1677 | -1143 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 16(I) | -1772 | -1325 | -4307 | -3877 | -1405 | -3993 | -3383 | 2935 | -3705 | 820 | -217 | -3632 | -3761 | -3400 | -3862 | -3260 | -1742 | 2033 | -2838 | -2525 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 17(T) | -1018 | -1329 | -2004 | -1771 | -409 | -1993 | -1000 | -1256 | -1512 | -1464 | -966 | -1543 | -2367 | -1428 | -1638 | -1257 | 3060 | -1090 | -1012 | 2448 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 18(Q) | -1509 | -3056 | 1970 | 44 | -3310 | -1666 | -896 | -3242 | -877 | -3158 | -2439 | -322 | -2123 | 3562 | -1493 | -1259 | -1550 | -2779 | -3260 | -2446 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 19(D) | -1006 | -2199 | 2178 | -88 | -3159 | 1997 | 936 | -2974 | -948 | -2977 | -2174 | -382 | -1960 | -589 | -1571 | 1295 | -1157 | -2369 | -3178 | -2430 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |

| | 13 | 14 | 15 | 16 | 17 | 18 | 19 | 20 | 21 | 22 | 23 | 24 |

TABLE 6-continued

| | | | | | | | | | | | | | | | | | | | | | |
|---|---|---|---|---|---|---|---|---|---|---|---|---|---|---|---|---|---|---|---|---|---|
| 20(M) | 445<br>-149<br>-16 | -796<br>-500<br>-7108 | -1082<br>233<br>-8150 | -521<br>43<br>-894 | -841<br>-381<br>-1115 | -1643<br>399<br>-701 | -412<br>106<br>-1378 | -403<br>-626<br>* | -370<br>210<br>* | -692<br>-466 | 2213<br>-720 | -646<br>275 | 536<br>394 | 1166<br>45 | -698<br>96 | -630<br>359 | 660<br>117 | 831<br>-369 | -1204<br>-294 | -767<br>-249 | 25 |
| 21(Q) | 741<br>-149<br>-16 | -990<br>-500<br>-7108 | -1025<br>233<br>-8150 | -507<br>43<br>-894 | -1249<br>-381<br>-1115 | -1551<br>399<br>-701 | -519<br>106<br>-1378 | -720<br>-626<br>* | -357<br>210<br>* | -1062<br>-466 | -345<br>-720 | -635<br>275 | -1739<br>394 | 1770<br>45 | -713<br>96 | -589<br>359 | 1576<br>117 | 1129<br>-369 | -1559<br>-294 | -1097<br>-249 | 26 |
| 22(R) | -1753<br>-149<br>-16 | -2648<br>-500<br>-7108 | -2072<br>233<br>-8150 | -1047<br>43<br>-894 | -3365<br>-381<br>-1115 | -2405<br>399<br>-701 | -452<br>106<br>-1378 | -2782<br>-626<br>* | 1989<br>210<br>* | -2495<br>-466 | -1773<br>-720 | -1062<br>275 | -2379<br>394 | 2402<br>45 | 1643<br>96 | -1629<br>359 | -1506<br>117 | -2504<br>-369 | -2397<br>-294 | -2190<br>-249 | 27 |
| 23(S) | -330<br>-149<br>-16 | -1010<br>-500<br>-7108 | -1820<br>233<br>-8150 | -1628<br>43<br>-894 | -2778<br>-381<br>-1115 | -1229<br>399<br>-701 | -1652<br>106<br>-1378 | -2481<br>-626<br>* | -1592<br>210<br>* | -2691<br>-466 | -1841<br>-720 | -1273<br>275 | 2130<br>394 | -1426<br>45 | -1834<br>96 | 2449<br>359 | 1034<br>117 | -1716<br>-369 | -2961<br>-294 | -2594<br>-249 | 28 |
| 24(P) | 1882<br>-149<br>-16 | -1119<br>-500<br>-7108 | -2231<br>233<br>-8150 | -2302<br>43<br>-894 | -3062<br>-381<br>-1115 | -1360<br>399<br>-701 | -2209<br>106<br>-1378 | -2710<br>-626<br>* | -2339<br>210<br>* | -3013<br>-466 | -2243<br>-720 | -1676<br>275 | 3304<br>394 | -2117<br>45 | -2409<br>96 | -742<br>359 | -918<br>117 | -1916<br>-369 | -3263<br>-294 | -3022<br>-249 | 29 |
| 25(N) | 969<br>-149<br>-16 | -1230<br>-500<br>-7108 | -1066<br>233<br>-8150 | -915<br>43<br>-894 | -2593<br>-381<br>-1115 | -1313<br>399<br>-701 | -1196<br>106<br>-1378 | -2242<br>-626<br>* | -1033<br>210<br>* | -2447<br>-466 | -1626<br>-720 | 3197<br>275 | -1850<br>394 | -898<br>45 | -1392<br>96 | -582<br>359 | 1155<br>117 | -1644<br>-369 | -2736<br>-294 | -2256<br>-249 | 30 |
| 26(R) | -1847<br>-149<br>-16 | -2640<br>-500<br>-7108 | -2014<br>233<br>-8150 | -1161<br>43<br>-894 | -3282<br>-381<br>-1115 | -2428<br>399<br>-701 | -579<br>106<br>-1378 | -2818<br>-626<br>* | 687<br>210<br>* | -2553<br>-466 | -1869<br>-720 | -1165<br>275 | -2462<br>394 | 2447<br>45 | 3318<br>96 | -1746<br>359 | -1630<br>117 | -2555<br>-369 | -2447<br>-294 | -2228<br>-249 | 31 |
| 27(A) | 3048<br>-149<br>-16 | -932<br>-500<br>-7108 | -2480<br>233<br>-8150 | -2533<br>43<br>-894 | -3075<br>-381<br>-1115 | -1200<br>399<br>-701 | -2274<br>106<br>-1378 | -2765<br>-626<br>* | -2501<br>210<br>* | -3071<br>-466 | -2221<br>-720 | -1658<br>275 | -1948<br>394 | -2205<br>45 | -2512<br>96 | 1225<br>359 | -739<br>117 | -1842<br>-369 | -3322<br>-294 | -3078<br>-249 | 32 |
| 28(M) | -2406<br>-149<br>-16 | -2296<br>-500<br>-7108 | -3638<br>233<br>-8150 | -3594<br>43<br>-894 | -1525<br>-381<br>-1115 | -3105<br>399<br>-701 | -2824<br>106<br>-1378 | -1047<br>-626<br>* | -3121<br>210<br>* | -596<br>-466 | 5043<br>-720 | -3293<br>275 | -3425<br>394 | -3046<br>45 | -2996<br>96 | -2911<br>359 | -2552<br>117 | -1398<br>-369 | -2513<br>-294 | -2207<br>-249 | 33 |
| 29(Y) | -1674<br>-149<br>-16 | -1506<br>-500<br>-7108 | -2863<br>233<br>-8150 | -2464<br>43<br>-894 | 596<br>-381<br>-1115 | -2872<br>399<br>-701 | 2251<br>106<br>-1378 | -972<br>-626<br>* | -2024<br>210<br>* | 2197<br>-466 | -552<br>-720 | -1986<br>275 | -2876<br>394 | -1739<br>45 | -1988<br>96 | -1987<br>359 | -1601<br>117 | -1002<br>-369 | -95<br>-294 | 2333<br>-249 | 34 |
| 30(Y) | -2013<br>-149<br>-16 | -2305<br>-500<br>-7108 | -2428<br>233<br>-8150 | -1781<br>43<br>-894 | -328<br>-381<br>-1115 | -2709<br>399<br>-701 | -654<br>106<br>-1378 | -2240<br>-626<br>* | -258<br>210<br>* | -2064<br>-466 | -1626<br>-720 | -1631<br>275 | -2788<br>394 | -899<br>45 | 2789<br>96 | -2017<br>359 | -1896<br>117 | -2130<br>-369 | -857<br>-294 | 3434<br>-249 | 35 |
| 31(A) | 2822<br>-149<br>-16 | -1031<br>-500<br>-7108 | -2418<br>233<br>-8150 | -2539<br>43<br>-894 | -3226<br>-381<br>-1115 | 1898<br>399<br>-701 | -2364<br>106<br>-1378 | -2941<br>-626<br>* | -2626<br>210<br>* | -3229<br>-466 | -2379<br>-720 | -1722<br>275 | -2026<br>394 | -2302<br>45 | -2634<br>96 | -654<br>359 | -848<br>117 | -1983<br>-369 | -3415<br>-294 | -3226<br>-249 | 36 |

TABLE 6-continued

| | | | | | | | | | | | | | | | | | | |
|---|---|---|---|---|---|---|---|---|---|---|---|---|---|---|---|---|---|---|
| 32(I) | -1247 | -941 | -3569 | -3039 | -1082 | -3101 | -2185 | -2763 | 766 | -76 | -2700 | -3050 | -2469 | -2697 | -2253 | 1322 | 1974 | -1988 | -1633 | 37 |
| - | -149 | -500 | 233 | 43 | -381 | 399 | 106 | -626 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | |
| 33(G) | -2594 | -2690 | -3304 | -3623 | -4328 | -3747 | -3462 | -3953 | -4671 | 4212 | -3320 | -3352 | -3748 | -3779 | -2839 | -2981 | -4004 | -3668 | -4222 | 38 |
| - | -149 | -500 | 233 | 43 | -381 | 399 | 106 | -626 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | |
| 34(F) | -1511 | -1236 | -3511 | -3017 | -2747 | -2982 | -1069 | -2651 | 992 | 2737 | -2407 | -2904 | -2088 | -2418 | -2099 | -1434 | 489 | -537 | 2056 | 39 |
| - | -149 | -500 | 233 | 43 | -381 | 399 | 106 | -626 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | |
| 35(Q) | -576 | -1869 | -401 | 92 | -2232 | 831 | -173 | -1930 | -1913 | -1042 | -186 | -1620 | -1653 | -51 | -482 | 1346 | -1534 | -2098 | -1490 | 40 |
| - | -149 | -500 | 233 | 43 | -381 | 399 | 106 | -626 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | |
| 36(D) | -1352 | -3066 | -3028 | 1349 | -3303 | -1566 | -724 | -3141 | -3043 | -2267 | -165 | -1991 | -354 | -1350 | -1086 | -1368 | -2659 | -3221 | -2356 | 41 |
| - | -149 | -500 | 233 | 43 | -381 | 399 | 106 | -626 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | |
| 37(E) | -1507 | -3288 | 2042 | 2762 | -3520 | 515 | -853 | -3401 | -3296 | -2566 | -182 | -2064 | -503 | -1753 | -1209 | -1553 | -2895 | -3486 | -2547 | 42 |
| - | -149 | -500 | 233 | 43 | -381 | 399 | 106 | -626 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | |
| 38(D) | -1445 | -2778 | -3529 | -53 | -3524 | -1590 | -1129 | -3476 | -3459 | -2774 | -396 | -2156 | -825 | -2122 | 554 | -1609 | -2880 | -3582 | -2717 | 43 |
| - | -149 | -500 | 233 | 43 | -381 | 399 | 106 | -626 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | |
| 39(F) | -2658 | -2176 | -4213 | -4000 | -3815 | -3933 | -1352 | -531 | 1121 | -19 | -3184 | -3709 | -2820 | -3296 | -3219 | -2579 | -1037 | -601 | 403 | 44 |
| - | -149 | -500 | 233 | 43 | -381 | 399 | 106 | -626 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | |
| 40(D) | -684 | -2193 | -1738 | 1460 | -2494 | -1437 | -249 | -2257 | -2199 | -1308 | -62 | -1637 | 185 | 450 | -531 | 633 | -1808 | -2374 | -1657 | 45 |
| - | -149 | -500 | 233 | 43 | -381 | 399 | 106 | -626 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | |
| 41(K) | -2620 | -2961 | -2461 | -2046 | -3743 | -2791 | -1570 | -3603 | -3387 | -2839 | -2048 | -3039 | -1260 | -465 | -2604 | -2536 | -3331 | -3001 | -2988 | 46 |
| - | -149 | -500 | 233 | 43 | -381 | 399 | 106 | -626 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | |
| 42(P) | 1882 | -1119 | -2231 | -2302 | -3062 | -1360 | -2209 | -2710 | -3013 | -2243 | -1676 | -3304 | -2117 | -2409 | -742 | -918 | -1916 | -3263 | -3022 | 47 |
| - | -149 | -500 | 233 | 43 | -381 | 399 | 106 | -626 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | |
| 43(I) | -1006 | -992 | -2347 | -1784 | -650 | -2452 | -1256 | -2372 | 77 | 2213 | -1720 | -2455 | 2030 | -1490 | -1528 | -946 | 106 | -1441 | -1111 | 48 |
| - | -149 | -500 | 233 | 43 | -381 | 399 | 106 | -626 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 44(V) | -1771 | -1603 | -3750 | -3689 | -2037 | -3050 | -3231 | 403 | -3479 | -1154 | -1076 | -3246 | -3399 | -3383 | -3437 | -2628 | -1917 | -3336 | -3074 | -2677 | 49 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 45(G) | -2594 | -2690 | -3304 | -3623 | -4328 | -3747 | -3462 | -4761 | -3953 | -4671 | -4212 | -3320 | -3352 | -3748 | -3779 | -2839 | -2981 | -4004 | -3668 | -4222 | 50 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 46(I) | -1759 | -1303 | -4330 | -3968 | -1751 | -4051 | -3743 | -3027 | -3837 | -597 | -528 | -3729 | -3875 | -3688 | -3910 | -3369 | -1751 | 2438 | -3259 | -2819 | 51 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 47(V) | 1736 | -1012 | -3546 | -3078 | -1377 | -3073 | -2434 | 2052 | -2843 | -608 | -331 | -2754 | -3122 | -2619 | -2855 | -2270 | -1277 | -2193 | -2333 | -1941 | 52 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 48(N) | -686 | -1511 | -702 | -806 | -2927 | -1386 | -1339 | -2841 | -1264 | -2950 | -2137 | -2702 | -1979 | -1062 | -1648 | 2444 | -971 | -2105 | -3054 | -2475 | 53 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 49(M) | -411 | -857 | -1800 | -1434 | -1528 | 1914 | -1202 | -1029 | -1247 | -1347 | -2980 | -1217 | -1912 | -1119 | -1444 | -676 | 1550 | -767 | -1922 | -1539 | 54 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 50(W) | -782 | -1258 | 793 | -683 | 1193 | 346 | 2051 | -932 | -556 | -1092 | 441 | -798 | -1993 | -426 | -909 | -904 | -720 | 779 | -3163 | 1546 | 55 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 51(W) | 1009 | -798 | -1470 | -935 | -463 | -1773 | -545 | -460 | -751 | -736 | -66 | -943 | -1904 | -606 | -1002 | 1604 | -507 | -322 | -2535 | 1521 | 56 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 52(D) | -1137 | -2711 | 1325 | 1647 | -2995 | -1523 | -617 | -2786 | -528 | -2743 | -1933 | -150 | -1897 | -234 | -1165 | -924 | 2117 | -2331 | -2948 | -2141 | 57 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 53(I) | -599 | -1102 | -1031 | -829 | -1522 | 1429 | -927 | -2119 | -880 | -1369 | -699 | 1692 | -1938 | -759 | -1188 | -799 | -698 | -689 | -1887 | -1419 | 58 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 54(T) | -666 | -1412 | -954 | -984 | -2702 | -1428 | -1357 | -2418 | -1208 | -2650 | -1886 | 2293 | -2000 | -1101 | -1519 | -787 | -2967 | -1835 | -2866 | -2360 | 59 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 55(P) | -632 | -1230 | -2074 | -2144 | -2996 | -1453 | -2116 | -2631 | -2128 | -2928 | -2213 | -1658 | -3610 | -2006 | -2221 | -852 | 1302 | -1931 | -3185 | -2917 | 60 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | |
|---|---|---|---|---|---|---|---|---|---|---|---|---|---|---|---|---|---|---|
| 56(C) | -2476 | -3735 | -4102 | -4358 | -3712 | -2763 | -3545 | -3518 | -4167 | -3859 | -3569 | -3631 | -3363 | -4030 | -3832 | -2793 | -2860 | -3158 | -3464 | -3718 | 61 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 57(N) | -2171 | -2655 | -1458 | -1748 | -3334 | -2364 | -2267 | -3943 | -2365 | -3936 | -3437 | 4205 | -2932 | -2205 | -2608 | -2224 | -2439 | -3392 | -3253 | -2909 | 62 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 58(M) | 672 | -918 | -3119 | -2578 | -742 | -2668 | -1734 | 1807 | -2263 | 16 | 3713 | -2271 | -2704 | -1960 | -2216 | -1806 | -1058 | 493 | -1612 | -1306 | 63 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 59(H) | -1525 | -2164 | -1235 | -1346 | -2509 | 2296 | 4235 | -3172 | -1516 | -3178 | -2523 | -1448 | -2541 | -1520 | -1760 | -1591 | -1741 | -2656 | -2681 | -2065 | 64 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 60(L) | -2478 | -2009 | -4717 | -4196 | -568 | -4424 | -3262 | 1334 | -3887 | 2824 | 604 | 4085 | -3872 | -3088 | -3590 | -3717 | -2380 | -199 | -2217 | -2207 | 65 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 61(H) | -682 | -2191 | 1015 | 275 | -2485 | 396 | 2379 | -2251 | 62 | -2197 | -1307 | 1826 | -1636 | 1527 | -480 | -529 | -641 | -1803 | -2375 | -1654 | 66 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 62(D) | -575 | -1920 | 1979 | 184 | -2299 | 94 | -242 | -2029 | 114 | -2023 | -1144 | -120 | -1608 | 186 | 1063 | 469 | 1413 | -1605 | -2229 | -1561 | 67 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 63(L) | -2618 | -2139 | -4597 | -4163 | 2144 | -4285 | -2334 | -83 | -3854 | 2690 | 538 | -3771 | -3806 | -2950 | -3488 | -3563 | -2505 | -751 | -1442 | -808 | 68 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 64(A) | 2657 | -1033 | -2408 | -2532 | -3233 | 2193 | -2364 | -2950 | -2626 | -3237 | -2386 | -1719 | -2027 | -2301 | -2635 | -655 | -850 | -1988 | -3420 | -3231 | 69 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 65(K) | -443 | -1857 | 958 | 270 | -2158 | -1393 | -66 | -1890 | 1839 | -442 | -957 | -36 | -1499 | 1204 | -132 | 616 | -382 | -1469 | -2048 | -1383 | 70 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 66(C) | 605 | 1553 | 739 | -17 | -1374 | -1488 | -182 | 260 | 969 | -203 | -397 | -263 | -1573 | 159 | 691 | 426 | -331 | -761 | -1567 | -1032 | 71 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 67(A) | 2327 | -956 | -3193 | -2728 | -1289 | -2677 | -2114 | 1664 | -2485 | -601 | -288 | -2403 | -2839 | -2263 | -2523 | -1871 | -1126 | 1617 | -2143 | -1765 | 62 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |

TABLE 6-continued

| | | | | | | | | | | | | | | | | | | | |
|---|---|---|---|---|---|---|---|---|---|---|---|---|---|---|---|---|---|---|---|
| 68(K) | -532 | -1656 | -490 | 1321 | -1891 | -1527 | -172 | -124 | 2206 | -1591 | -782 | -223 | -1619 | 237 | -106 | 482 | -464 | -98 | -1904 | -1326 | 73 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 69(H) | 384 | -1854 | 936 | 889 | -2165 | -1363 | -1498 | -1909 | 1111 | -1866 | -948 | 1091 | -1464 | 421 | -131 | -284 | -342 | -69 | -2043 | -1364 | 74 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 70(G) | 1823 | -932 | -2330 | -2313 | -3120 | -2811 | -2158 | -2865 | -2331 | -3098 | -2209 | -1563 | -1912 | -2032 | -2419 | 1138 | -706 | -1883 | -3328 | -3077 | 75 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 71(V) | -1760 | -1333 | -4244 | -3789 | -1262 | -3902 | -3190 | 1495 | -3588 | 1270 | -96 | -3536 | -3677 | -3238 | -3534 | -3148 | -1725 | -2865 | -2654 | -2373 | 76 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 72(W) | -1054 | -2172 | -1112 | -403 | -2566 | -1917 | -286 | -2196 | 2516 | -2095 | -1292 | 1183 | -1958 | 140 | 1333 | -959 | -922 | -1867 | 2591 | -1720 | 77 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 73(D) | 611 | -1995 | 1525 | 937 | -2295 | -1400 | -148 | -2043 | 211 | -2006 | -1106 | -37 | -1553 | 1420 | -312 | -408 | 1235 | -1609 | -2193 | -1499 | 78 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 74(A) | -902 | -902 | -2380 | -2205 | -2799 | -1197 | -1975 | -2459 | -2081 | -2736 | -1895 | -1520 | -1895 | -1844 | -2201 | 1191 | 1299 | -1669 | -3045 | -2758 | 79 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 75(G) | -1709 | -2833 | 2424 | 409 | -3781 | -2819 | -1457 | -3777 | -1728 | -3733 | -3076 | -739 | -2389 | -1180 | -2441 | -1557 | -1893 | -3158 | -3660 | -3038 | 80 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 76(A) | 2529 | -1119 | -2614 | -2330 | -1245 | -1983 | -1829 | -377 | -2042 | 1435 | -341 | -1937 | -2411 | -1873 | -2088 | -1266 | -1059 | -397 | -2063 | -1713 | 82 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 77(W) | -472 | -361 | -2421 | -1812 | -298 | -1979 | -826 | 1164 | -1486 | -143 | 2485 | 873 | -2028 | -1185 | -1426 | -1048 | 412 | 1116 | 2999 | -454 | 83 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 78(P) | -1198 | -1737 | -2187 | -2394 | -3665 | 2006 | -2550 | -3630 | -2743 | -3756 | -3008 | -2052 | 3474 | -2495 | -2835 | -1401 | -1593 | -2736 | -3511 | -3519 | 84 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |
| 79(Q) | -999 | -1075 | -2106 | -1568 | -726 | -2370 | -1175 | 83 | -1185 | 1373 | 218 | -1566 | -2400 | 2445 | -1340 | -1445 | -946 | 1441 | -1501 | -1146 | 85 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | | |

TABLE 6-continued

| | | | | | | | | | | | | | | | | | |
|---|---|---|---|---|---|---|---|---|---|---|---|---|---|---|---|---|---|
| 80(Q) | -885 | -779 | -2609 | -2018 | 481 | -2414 | -1253 | 1645 | -1736 | 799 | 1924 | -1827 | -2405 | -1752 | -1484 | -821 | 802 | -1240 | -935 | 86 |
| - | -149 | -500 | 233 | 43 | -381 | 399 | 106 | -626 | 210 | -466 | -720 | 275 | 394 | 96 | 359 | 117 | -369 | -294 | -249 | |
| - | -16 | -7108 | -8150 | -894 | -1115 | -701 | -1378 | * | * | | | | | | | | | | | |
| 81(F) | -3342 | -2776 | -4026 | -4232 | -4354 | -3545 | -1431 | -2315 | -4038 | -1801 | -1900 | -3299 | -3780 | -3645 | -3490 | -3420 | -2566 | -739 | 349 | 87 |
| - | -149 | -500 | 233 | 43 | -381 | 399 | 106 | -626 | 210 | -466 | -720 | 275 | 394 | 96 | 359 | 117 | -369 | -294 | -249 | |
| - | -16 | -7108 | -8150 | -894 | -1115 | -701 | -1378 | * | * | | | | | | | | | | | |
| 82(G) | -998 | -2100 | -120 | -175 | -2567 | 2528 | 2174 | -2558 | -587 | -2583 | -1806 | 1422 | -1966 | -1038 | -925 | -1088 | -2095 | -2657 | -1948 | 88 |
| - | -149 | -500 | 233 | 43 | -381 | 399 | 106 | -626 | 210 | -466 | -720 | 275 | 394 | 96 | 359 | 117 | -369 | -294 | -249 | |
| - | -16 | -7108 | -8150 | -894 | -1115 | -701 | -1378 | * | * | | | | | | | | | | | |
| 83(T) | -1213 | -1674 | -2755 | -2906 | -3163 | -1922 | -2659 | -2698 | -2788 | -3105 | -2612 | -2311 | -2600 | -2753 | -1463 | -3819 | -2197 | -3286 | -3156 | 89 |
| - | -149 | -500 | 233 | 43 | -381 | 399 | 106 | -626 | 210 | -466 | -720 | 275 | 394 | 96 | 359 | 117 | -369 | -294 | -249 | |
| - | -16 | -7108 | -8150 | -894 | -1115 | -701 | -1378 | * | * | | | | | | | | | | | |
| 84(I) | -1286 | -1279 | -2907 | -2683 | -1446 | -2549 | -2198 | -3290 | -2407 | -726 | -534 | -2386 | 1172 | -2437 | -1895 | -1392 | 283 | -2302 | -1913 | 90 |
| - | -149 | -500 | 233 | 43 | -381 | 399 | 106 | -626 | 210 | -466 | -720 | 275 | 394 | 96 | 359 | 117 | -369 | -294 | -249 | |
| - | -16 | -7108 | -8150 | -894 | -1115 | -701 | -1378 | * | * | | | | | | | | | | | |
| 85(T) | -493 | -1105 | -2189 | -2267 | -3101 | 1880 | -2196 | -2791 | -2334 | -3081 | -2269 | -1649 | -2058 | -2410 | -719 | -3135 | -1948 | -3282 | -3046 | 91 |
| - | -149 | -500 | 233 | 43 | -381 | 399 | 106 | -626 | 210 | -466 | -720 | 275 | 394 | 96 | 359 | 117 | -369 | -294 | -249 | |
| - | -16 | -7108 | -8150 | -894 | -1115 | -701 | -1378 | * | * | | | | | | | | | | | |
| 86(V) | -1750 | -1296 | -4319 | -3957 | -1765 | -4038 | -3733 | 2364 | -3826 | -619 | -543 | -3716 | -3869 | -3902 | -3354 | -1743 | 3012 | -3265 | -2817 | 92 |
| - | -149 | -500 | 233 | 43 | -381 | 399 | 106 | -626 | 210 | -466 | -720 | 275 | 394 | 96 | 359 | 117 | -369 | -294 | -249 | |
| - | -16 | -7108 | -8150 | -894 | -1115 | -701 | -1378 | * | * | | | | | | | | | | | |
| 87(S) | 923 | -962 | -2348 | -2422 | -3132 | -1207 | -2248 | -2850 | -2440 | -3140 | -2285 | -1624 | -1954 | -2477 | 3171 | 758 | -1896 | -3362 | -3103 | 93 |
| - | -149 | -500 | 233 | 43 | -381 | 399 | 106 | -626 | 210 | -466 | -720 | 275 | 394 | 96 | 359 | 117 | -369 | -294 | -249 | |
| - | -16 | -7108 | -8150 | -894 | -1115 | -701 | -1378 | * | * | | | | | | | | | | | |
| 88(D) | -2784 | -3432 | -4016 | -1200 | -4140 | -2466 | -2197 | -4505 | -2621 | -4365 | -3956 | -1551 | -3014 | -3232 | -2593 | -2938 | -4046 | -3710 | -3552 | 94 |
| - | -149 | -500 | 233 | 43 | -381 | 399 | 106 | -626 | 210 | -466 | -720 | 275 | 394 | 96 | 359 | 117 | -369 | -294 | -249 | |
| - | -16 | -7108 | -8150 | -894 | -1115 | -701 | -1378 | * | * | | | | | | | | | | | |
| 89(G) | -2594 | -2690 | -3304 | -3623 | -4328 | -3747 | -3462 | -4761 | -3953 | -4671 | -4212 | -3320 | -3352 | -3779 | -2839 | -2981 | -4004 | -3668 | -4222 | 95 |
| - | -149 | -500 | 233 | 43 | -381 | 399 | 106 | -626 | 210 | -466 | -720 | 275 | 394 | 96 | 359 | 117 | -369 | -294 | -249 | |
| - | -16 | -7108 | -8150 | -894 | -1115 | -701 | -1378 | * | * | | | | | | | | | | | |
| 90(I) | -1880 | -1493 | -4193 | -3724 | -953 | -3837 | -2980 | 3251 | -3420 | 257 | 2372 | -3485 | -3608 | -3310 | -3087 | -1840 | 617 | -2373 | -2155 | 96 |
| - | -149 | -500 | 233 | 43 | -381 | 399 | 106 | -626 | 210 | -466 | -720 | 275 | 394 | 96 | 359 | 117 | -369 | -294 | -249 | |
| - | -16 | -7108 | -8150 | -894 | -1115 | -701 | -1378 | * | * | | | | | | | | | | | |
| 91(S) | 2150 | -939 | -2407 | -2415 | -3075 | -1197 | -2205 | -2781 | -2384 | -3065 | -2205 | -1613 | -1936 | -2436 | 2652 | -729 | -1850 | -3306 | -3049 | 97 |
| - | -149 | -500 | 233 | 43 | -381 | 399 | 106 | -626 | 210 | -466 | -720 | 275 | 394 | 96 | 359 | 117 | -369 | -294 | -249 | |
| - | -16 | -7108 | -8150 | -894 | -1115 | -701 | -1378 | * | * | | | | | | | | | | | |

TABLE 6-continued

| | | | | | | | | | | | | | | | | | | |
|---|---|---|---|---|---|---|---|---|---|---|---|---|---|---|---|---|---|---|
| 92(M) | -979 | -1455 | -1242 | -1122 | -1434 | -1860 | -1131 | -1171 | -974 | -1285 | 4091 | 2176 | -2226 | -1017 | -1187 | -1166 | -1086 | -1063 | -1929 | -1345 | 98 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 93(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 99 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 94(T) | -959 | -1691 | -1249 | -949 | -2563 | -1747 | -929 | -2093 | 1282 | -2263 | -1554 | -995 | -2115 | -600 | -354 | -1037 | 3152 | -1726 | -2494 | -2098 | 100 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 95(E) | -572 | -1860 | -208 | 2213 | -2107 | -1461 | -191 | -1808 | 199 | -116 | -983 | -127 | 318 | 1199 | -269 | -475 | -517 | -1448 | -2078 | -1441 | 101 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 96(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 102 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 97(M) | -2406 | -2296 | -3638 | -3594 | -1525 | -3105 | -2824 | -1047 | -3121 | -596 | 5043 | -3293 | -3425 | -3046 | -2996 | -2911 | -2552 | -1398 | -2513 | -2207 | 103 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 98(R) | -2097 | -2786 | -2688 | -1415 | -3622 | -2625 | -555 | -2964 | 2585 | -2627 | -1957 | -1318 | -2577 | -137 | 3015 | -1979 | -1791 | -2732 | -2469 | -2363 | 104 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 99(Y) | -3615 | -2706 | -4169 | -4413 | 2626 | -4044 | -396 | -2535 | -3993 | -1939 | -1985 | -2747 | -3930 | -2852 | -3446 | -3296 | -3494 | -2686 | 347 | 4252 | 105 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 100(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 106 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 101(L) | -2871 | -2457 | -4231 | -4103 | -1033 | -3803 | -3165 | -541 | -3734 | 3130 | -31 | -3935 | -3797 | -3286 | -3484 | -3713 | -2869 | -1136 | -2394 | -2220 | 107 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 102(V) | -1381 | -1065 | -3714 | -3252 | -1453 | -3300 | -2646 | 1872 | -3023 | -615 | -373 | -2949 | -3287 | -2816 | -3039 | -2506 | 1346 | 2750 | -2489 | -2087 | 108 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 103(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 109 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |

TABLE 6-continued

| | | | | | | | | | | | | | | | | | | | | | |
|---|---|---|---|---|---|---|---|---|---|---|---|---|---|---|---|---|---|---|---|---|---|
| 104(R) | -2957 | -3022 | -3318 | -2735 | -3796 | -2998 | -1968 | -3912 | -846 | -3631 | -3157 | -2611 | -3280 | -1724 | 4056 | -3026 | -2913 | -3650 | -3096 | -3185 | 110 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 105(E) | -1719 | -3572 | 2596 | 2779 | -3767 | -1632 | -993 | -3700 | -1241 | -3578 | -2920 | -234 | -2167 | -666 | -2090 | -1380 | -1789 | -3182 | -3742 | -2756 | 111 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 106(V) | -1746 | -1296 | -4308 | -3946 | -1757 | -4020 | -3712 | -2190 | -3811 | -614 | -539 | -3702 | -3858 | -3667 | -3884 | -3336 | -1740 | 3098 | -3250 | -2803 | 112 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 107(I) | -2091 | -1746 | -3971 | -3840 | -1676 | -3532 | -3289 | 3684 | -3581 | -659 | -693 | -3562 | -3674 | -3445 | -3521 | -3194 | -2146 | 449 | -2877 | -2493 | 113 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 108(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 114 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 109(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 115 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 110(S) | -352 | 2942 | -2955 | -2957 | -2876 | -1254 | -2382 | -2573 | -2692 | -2927 | -2128 | -1827 | -2001 | -2405 | -2607 | 3103 | -778 | -1757 | -3171 | -2911 | 116 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 111(I) | -2091 | -1746 | -3971 | -3840 | -1676 | -3532 | -3289 | 3684 | -3581 | -659 | -693 | -3562 | -3674 | -3445 | -3521 | -3194 | -2146 | 449 | -2877 | -2493 | 117 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 112(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 118 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 113(T) | 1556 | -936 | -2493 | -2457 | -2805 | -1256 | -2159 | -2210 | -2319 | -2681 | -1932 | -1656 | -1974 | -2089 | -2352 | -598 | 3235 | -1547 | -3111 | -2847 | 119 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 114(C) | 1784 | 2119 | -2013 | -1532 | -1093 | -1580 | -1089 | -436 | -1322 | -937 | -273 | 1093 | -1932 | -1127 | -1472 | -748 | -515 | 1585 | -1536 | -1163 | 120 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 115(M) | 1831 | 2019 | -2596 | -2038 | -605 | -1979 | -1126 | 244 | -1727 | -359 | 2501 | -1655 | -2145 | -1435 | -1683 | -1106 | -557 | 1087 | -1153 | -804 | 121 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| Row | C1 | C2 | C3 | C4 | C5 | C6 | C7 | C8 | C9 | C10 | C11 | C12 | C13 | C14 | C15 | C16 | C17 | C18 | C19 | C20 | ID |
|---|---|---|---|---|---|---|---|---|---|---|---|---|---|---|---|---|---|---|---|---|---|
| 116(Q) / – | -987 / -149 / -16 | -2211 / -500 / -7108 | -43 / 233 / -8150 | -62 / 43 / -894 | -2833 / -381 / -1115 | 2229 / 399 / -701 | -691 / 106 / -1378 | -2616 / -626 / * | 407 / 210 / * | -2604 / -466 | -1797 / -720 | 1197 / 275 | -1917 / 394 | 2260 / 45 | -858 / 96 | -880 / 359 | -1045 / 117 | -2139 / -369 | -2772 / -294 | -2099 / -249 | 122 |
| 117(G) / – | 2313 / -149 / -16 | -1042 / -500 / -7108 | -2391 / 233 / -8150 | -2526 / 43 / -894 | -3250 / -381 / -1115 | 2601 / 399 / -701 | -2372 / 106 / -1378 | -2972 / -626 / * | -2637 / 210 / * | -3257 / -466 | -2407 / -720 | -1721 / 275 | -2032 / 394 | -2310 / 45 | -2646 / 96 | -662 / 359 | -859 / 117 | -2003 / -369 | -3434 / -294 | -3247 / -249 | 123 |
| 118(Q) / – | -914 / -149 / -16 | -2350 / -500 / -7108 | -48 / 233 / -8150 | 1661 / 43 / -894 | -2621 / -381 / -1115 | -1571 / 399 / -701 | 2504 / 106 / -1378 | -2400 / -626 / * | 68 / 210 / * | -2331 / -466 | -1486 / -720 | -201 / 275 | -1796 / 394 | 2646 / 45 | -351 / 96 | -754 / 359 | -865 / 117 | -1984 / -369 | -2463 / -294 | -1787 / -249 | 124 |
| 119(W) / – | -517 / -149 / -16 | -1294 / -500 / -7108 | -733 / 233 / -8150 | -183 / 43 / -894 | -1062 / -381 / -1115 | -1605 / 399 / -701 | -234 / 106 / -1378 | -1037 / -626 / * | 19 / 210 / * | -1207 / -466 | -456 / -720 | 1435 / 275 | -1690 / 394 | 33 / 45 | 756 / 96 | 411 / 359 | -454 / 117 | -819 / -369 | 3340 / -294 | 1286 / -249 | 125 |
| 120(M) / – | 410 / -149 / -16 | -469 / -500 / -7108 | -2417 / 233 / -8150 | -1828 / 43 / -894 | -341 / -381 / -1115 | -2041 / 399 / -701 | -897 / 106 / -1378 | 195 / -626 / * | -1513 / 210 / * | -156 / -466 | 3130 / -720 | -1534 / 275 | -2102 / 394 | -1230 / 45 | -1484 / 96 | -1117 / 359 | -507 / 117 | 954 / -369 | -894 / -294 | 2253 / -249 | 126 |
| 121(D) / – | -2784 / -149 / -16 | -3432 / -500 / -7108 | 4016 / 233 / -8150 | -1200 / 43 / -894 | -4140 / -381 / -1115 | -2466 / 399 / -701 | -2197 / 106 / -1378 | -4505 / -626 / * | -2621 / 210 / * | -4365 / -466 | -3956 / -720 | -1551 / 275 | -3014 / 394 | -2039 / 45 | -3232 / 96 | -2593 / 359 | -2938 / 117 | 4046 / -369 | -3710 / -294 | -3552 / -249 | 127 |
| 122(G) / – | 2142 / -149 / -16 | -930 / -500 / -7108 | -2334 / 233 / -8150 | -2298 / 43 / -894 | -3100 / -381 / -1115 | 2237 / 399 / -701 | -2139 / 106 / -1378 | -2842 / -626 / * | -2302 / 210 / * | -3074 / -466 | -2187 / -720 | -1557 / 275 | -1909 / 394 | -2010 / 45 | -2397 / 96 | 1136 / 359 | -701 / 117 | -1871 / -369 | -3308 / -294 | -3053 / -249 | 128 |
| 123(V) / – | -1514 / -149 / -16 | -1144 / -500 / -7108 | -3950 / 233 / -8150 | -3459 / 43 / -894 | 1821 / -381 / -1115 | -3487 / 399 / -701 | -2577 / 106 / -1378 | 2274 / -626 / * | -3208 / 210 / * | -209 / -466 | -87 / -720 | -3112 / 275 | -3362 / 394 | -2864 / 45 | -3118 / 96 | -2680 / 359 | -1476 / 117 | 3426 / -369 | -2194 / -294 | -1786 / -249 | 129 |
| 124(V) / – | -1743 / -149 / -16 | -1294 / -500 / -7108 | -4292 / 233 / -8150 | -3873 / 43 / -894 | -1511 / -381 / -1115 | -3988 / 399 / -701 | -3433 / 106 / -1378 | 2287 / -626 / * | -3712 / 210 / * | 598 / -466 | -319 / -720 | -3626 / 275 | -3774 / 394 | -3456 / 45 | -3716 / 96 | -3260 / 359 | -1717 / 117 | 2790 / -369 | -2931 / -294 | -2577 / -249 | 130 |
| 125(A) / – | 2931 / -149 / -16 | -954 / -500 / -7108 | -2808 / 233 / -8150 | -2665 / 43 / -894 | -2115 / -381 / -1115 | -1577 / 399 / -701 | -2196 / 106 / -1378 | -575 / -626 / * | -2445 / 210 / * | -1646 / -466 | -1202 / -720 | -1906 / 275 | -2208 / 394 | -2218 / 45 | -2451 / 96 | -901 / 359 | -876 / 117 | 1294 / -369 | -2727 / -294 | -2394 / -249 | 131 |
| 126(I) / – | -1764 / -149 / -16 | -1323 / -500 / -7108 | -4298 / 233 / -8150 | -3936 / 43 / -894 | -1668 / -381 / -1115 | -3994 / 399 / -701 | -3655 / 106 / -1378 | 3337 / -626 / * | -3783 / 210 / * | -508 / -466 | -462 / -720 | -3689 / 275 | -3838 / 394 | -3608 / 45 | -3835 / 96 | -3311 / 359 | -1759 / 117 | 1847 / -369 | -3164 / -294 | -2747 / -249 | 132 |
| 127(G) / – | -1157 / -149 / -16 | -1705 / -500 / -7108 | -2169 / 233 / -8150 | -2375 / 43 / -894 | -3654 / -381 / -1115 | 3021 / 399 / -701 | -2534 / 106 / -1378 | -3611 / -626 / * | -2730 / 210 / * | -3741 / -466 | -2984 / -720 | -2024 / 275 | 2418 / 394 | -2475 / 45 | -2826 / 96 | -1361 / 359 | -1555 / 117 | -2705 / -369 | -3513 / -294 | -3509 / -249 | 133 |

TABLE 6-continued

| | | | | | | | | | | | | | | | | | |
|---|---|---|---|---|---|---|---|---|---|---|---|---|---|---|---|---|---|
| 128(G) | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 134 |
| 129(C) | -2476 -149 -16 | -3735 -500 -7108 | -4102 -8150 | -4358 -894 | -3712 -381 -1115 | -2763 399 -701 | -3545 106 -1378 | -3518 -626 * | -4167 210 * | -3859 -466 | -3569 -720 | -3631 275 | -3363 394 | -4030 45 | -3832 96 | -2793 359 | -2860 117 | -3158 -369 | -3464 -294 | -3718 -249 | 135 |
| 130(D) | -2784 -149 -16 | -3432 -500 -7108 | -4016 233 -8150 | -1200 43 -894 | -4140 -381 -1115 | -2466 399 -701 | -2197 106 -1378 | -4505 -626 * | -2621 210 * | -4365 -466 | -3956 -720 | -1551 275 | -3014 394 | -2039 45 | -3232 96 | -2593 359 | -2938 117 | -4046 -369 | -3710 -294 | -3552 -249 | 136 |
| 131(K) | -2620 -149 -16 | -2961 -500 -7108 | -2461 233 -8150 | -2046 43 -894 | -3743 -381 -1115 | -2791 399 -701 | -1570 106 -1378 | -3603 -626 * | -3784 210 * | -3387 -466 | -2839 -720 | -2048 275 | -3039 394 | -1260 45 | -465 96 | -2604 359 | -2536 117 | -3331 -369 | -3001 -294 | -2988 -249 | 137 |
| 132(N) | -2171 -149 -16 | -2655 -500 -7108 | -1458 233 -8150 | -1748 43 -894 | -3334 -381 -1115 | -2364 399 -701 | -2267 106 -1378 | -3943 -626 * | -2365 210 * | -3936 -466 | -3437 -720 | -4205 275 | -2932 394 | -2205 45 | -2608 96 | -2224 359 | -2439 117 | -3392 -369 | -3253 -294 | -2909 -249 | 138 |
| 133(M) | -2406 -149 -16 | -2296 -500 -7108 | -3638 233 -8150 | -3594 43 -894 | -1525 -381 -1115 | -3105 399 -701 | -2824 106 -1378 | -1047 -626 * | -3121 210 * | -596 -466 | -5043 -720 | -3293 275 | -3425 394 | -3046 45 | -2996 96 | -2911 359 | -2552 117 | -1398 -369 | -2513 -294 | -2207 -249 | 139 |
| 134(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | -4225 394 | -3781 45 | -3695 96 | -3182 359 | -3279 117 | -4087 -369 | -3594 -294 | -4064 -249 | 140 |
| 135(G) | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4761 -466 | -4212 -720 | -3320 275 | -3352 394 | -3748 45 | -3779 96 | -2839 359 | -2981 117 | -4004 -369 | -3668 -294 | -4222 -249 | 141 |
| 136(A) | -2180 -149 -16 | -935 -500 -7108 | -2286 233 -8150 | -2196 43 -894 | -3057 -381 -1115 | -1098 399 -701 | -2058 106 -1378 | -2796 -626 * | -2174 210 * | -3021 -466 | -2134 -720 | -1516 275 | -1898 394 | -1906 45 | -2302 96 | 2146 359 | -689 117 | -1849 -369 | -3256 -294 | -2983 -249 | 142 |
| 137(M) | -1799 -149 -16 | -1433 -500 -7108 | -4142 233 -8150 | -3579 43 -894 | -669 -381 -1115 | -3668 399 -701 | -2608 106 -1378 | 1558 -626 * | -3293 210 * | 1235 -466 | -3799 -720 | -3296 275 | -3401 394 | -2717 45 | -3088 96 | -2843 359 | -1726 117 | 1156 -369 | -2002 -294 | -1868 -249 | 143 |
| 138(I) | -2091 -149 -16 | -1746 -500 -7108 | -3971 233 -8150 | -3840 43 -894 | -1676 -381 -1115 | -3532 399 -701 | -3289 106 -1378 | -3684 -626 * | -3581 210 * | -659 -466 | -693 -720 | -3562 275 | -3674 394 | -3445 45 | -3521 96 | -3194 359 | -2146 117 | 449 -369 | -2877 -294 | -2493 -249 | 144 |
| 139(A) | -3103 -149 -16 | -1036 -500 -7108 | -2445 233 -8150 | -2572 43 -894 | -3222 -381 -1115 | 1051 399 -701 | -2380 106 -1378 | -2930 -626 * | -2650 210 * | -3226 -466 | -2381 -720 | -1739 275 | -2034 394 | -2327 45 | -2648 96 | -664 359 | -857 117 | -1981 -369 | -3412 -294 | -3228 -249 | 145 |

TABLE 6-continued

| | | | | | | | | | | | | | | | | | | |
|---|---|---|---|---|---|---|---|---|---|---|---|---|---|---|---|---|---|---|
| 140(M) | -2325 -149 -16 | -1891 -500 -7108 | -4598 233 -8150 | -4012 43 -894 | -498 -381 -1115 | -4222 399 -701 | -3013 106 -1378 | 1242 -626 * | -3722 210 * | 1864 -466 | 3939 -720 | -3855 275 | -3711 394 | -2910 45 | -3414 96 | -3439 359 | -2215 117 | -299 -369 | -2076 -294 | -2098 -249 | 146 |
| 141(A) | 3103 -149 -16 | -1036 -500 -7108 | -2445 233 -8150 | -2572 43 -894 | -3222 -381 -1115 | 1051 399 -701 | -2380 106 -1378 | -2930 -626 * | -2650 210 * | -3226 -466 | -2381 -720 | -1739 275 | -2034 394 | -2327 45 | -2648 96 | -664 359 | -857 117 | -1981 -369 | -3412 -294 | -3228 -249 | 147 |
| 142(R) | -1588 -149 -16 | -2442 -500 -7108 | -1399 233 -8150 | -953 43 -894 | -3069 -381 -1115 | -2171 399 -701 | -708 106 -1378 | -2795 -626 * | 373 210 * | -2625 -466 | -1916 -720 | 1858 275 | -2357 394 | -324 45 | 3294 96 | -1520 359 | -1505 117 | -2453 -369 | -2523 -294 | -2186 -249 | 148 |
| 143(M) | -1448 -149 -16 | -1256 -500 -7108 | -3396 233 -8150 | -2819 43 -894 | -474 -381 -1115 | -3024 399 -701 | -1923 106 -1378 | 175 -626 * | -2473 210 * | 2225 -466 | 2756 -720 | -2574 275 | -2922 394 | -2063 45 | -2375 96 | -2153 359 | 952 117 | -151 -369 | -1599 -294 | -1410 -249 | 149 |
| 144(N) | -1662 -149 -16 | -3306 -500 -7108 | 2055 233 -8150 | -3621 78 -894 | -381 -1115 | -1643 399 -701 | -1040 106 -1378 | -3622 -626 * | -1272 210 * | -3531 -466 | -2870 -720 | 3477 275 | -2182 394 | -724 45 | -2071 96 | -1371 359 | -1757 117 | -3092 -369 | -3633 -294 | -2700 -249 | 150 |
| 145(I) | -1066 -149 -16 | -921 -500 -7108 | -2828 233 -8150 | -2239 43 -894 | -1041 -381 -1115 | -2675 399 -701 | -1601 106 -1378 | 3235 -626 * | -1668 210 * | -455 -466 | -92 -720 | -2067 275 | -2692 394 | -1688 45 | 1701 96 | -1795 359 | -1024 117 | 1960 -369 | -1771 -294 | -1396 -249 | 151 |
| 146(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 152 |
| 147(S) | 1568 -149 -16 | -940 -500 -7108 | -2267 233 -8150 | -2192 43 -894 | -3082 -381 -1115 | 1101 399 -701 | -2068 106 -1378 | -2826 -626 * | -2185 210 * | -3049 -466 | -2159 -720 | -1515 275 | -1901 394 | -1915 45 | -2313 96 | 2603 359 | -694 117 | -1866 -369 | -3279 -294 | -3006 -249 | 153 |
| 148(I) | -1880 -149 -16 | -1492 -500 -7108 | -4195 233 -8150 | -3728 43 -894 | -963 -381 -1115 | -3841 399 -701 | -2991 106 -1378 | 3272 -626 * | -3425 210 * | 246 -466 | 2277 -720 | -3490 275 | -3613 394 | -3014 45 | -3317 96 | -3092 359 | -1841 117 | 628 -369 | -2385 -294 | -2163 -249 | 154 |
| 149(F) | -2204 -149 -16 | -1797 -500 -7108 | -3724 233 -8150 | -3473 43 -894 | 3206 -381 -1115 | -3383 399 -701 | -628 106 -1378 | -1077 -626 * | -3092 210 * | -746 -466 | 3167 -720 | -2502 275 | -3309 394 | -2372 45 | -2792 96 | -2535 359 | -2120 117 | -1245 -369 | 28 -294 | 2460 -249 | 155 |
| 150(V) | 1265 -149 -16 | -1028 -500 -7108 | -3200 233 -8150 | -2994 43 -894 | -1833 -381 -1115 | -2150 399 -701 | -2480 106 -1378 | 417 -626 * | -2771 210 * | -1122 -466 | -818 -720 | -2349 275 | -2640 394 | -2559 45 | -2766 96 | -1464 359 | -1118 117 | 3028 -369 | -2700 -294 | -2325 -249 | 156 |
| 151(Y) | -3482 -149 -16 | -2868 -500 -7108 | -3701 233 -8150 | -3919 43 -894 | 238 -381 -1115 | -3552 399 -701 | -1112 106 -1378 | -3000 -626 * | -3638 210 * | -2516 -466 | -2526 -720 | -3027 275 | -3772 394 | -3101 45 | -3341 96 | -3418 359 | -3527 117 | -3071 -369 | -441 -294 | 4711 -249 | 157 |

TABLE 6-continued

| | | | | | | | | | | | | | | | | |
|---|---|---|---|---|---|---|---|---|---|---|---|---|---|---|---|---|
| 152(G) | -2594<br>-149<br>-16 | -2690<br>-500<br>-7108 | -3304<br>233<br>-8150 | -3623<br>43<br>-894 | -4328<br>-381<br>-1115 | 3747<br>399<br>-701 | -3462<br>106<br>-1378 | -4761<br>-626<br>* | -3953<br>210<br>* | -4671<br>-466 | -4212<br>-720 | -3320<br>275 | -3352<br>394 | -3748<br>45 | -3779<br>96 | -2839<br>359 | -2981<br>117 | 4004<br>-369 | -3668<br>-294 | -4222<br>-249 | 158 |
| 153(G) | -2594<br>-149<br>-16 | -2690<br>-500<br>-7108 | -3304<br>233<br>-8150 | -3623<br>43<br>-894 | -4328<br>-381<br>-1115 | 3747<br>399<br>-701 | -3462<br>106<br>-1378 | -4761<br>-626<br>* | -3953<br>210<br>* | -4671<br>-466 | -4212<br>-720 | -3320<br>275 | -3352<br>394 | -3748<br>45 | -3779<br>96 | -2839<br>359 | -2981<br>117 | 4004<br>-369 | -3668<br>-294 | -4222<br>-249 | 159 |
| 154(T) | -359<br>-149<br>-16 | -976<br>-500<br>-7108 | -2225<br>233<br>-8150 | -2229<br>-894 | -2900<br>-381<br>-1115 | -1242<br>399<br>-701 | -2074<br>106<br>-1378 | -2560<br>-626<br>* | -2170<br>210<br>* | -2875<br>-466 | -2064<br>-720 | -1561<br>275 | -1958<br>394 | -1969<br>45 | -2247<br>96 | 1110<br>359 | 3375<br>117 | -1760<br>-369 | -3152<br>-294 | -2850<br>-249 | 160 |
| 155(I) | -2091<br>-149<br>-16 | -1746<br>-500<br>-7108 | -3971<br>233<br>-8150 | -3840<br>43<br>-894 | -1676<br>-381<br>-1115 | -3532<br>399<br>-701 | -3289<br>106<br>-1378 | 3684<br>-626<br>* | -3581<br>210<br>* | -659<br>-466 | -693<br>-720 | -3562<br>275 | -3674<br>394 | -3445<br>45 | -3521<br>96 | -3194<br>359 | -2146<br>117 | 449<br>-369 | -2877<br>-294 | -2493<br>-249 | 161 |
| 156(H) | 861<br>-149<br>-16 | -1924<br>-500<br>-7108 | -384<br>233<br>-8150 | 1010<br>43<br>-894 | -2260<br>-381<br>-1115 | -1477<br>399<br>-701 | 1787<br>106<br>-1378 | -1974<br>-626<br>* | 1769<br>210<br>* | -1918<br>-466 | -1022<br>-720 | -120<br>275 | -1566<br>394 | 362<br>45 | 697<br>96 | -417<br>359 | -459<br>117 | -1557<br>-369 | -2073<br>-294 | -1446<br>-249 | 162 |
| 157(P) | -655<br>-149<br>-16 | -1502<br>-500<br>-7108 | -711<br>233<br>-8150 | -557<br>43<br>-894 | -2204<br>-381<br>-1115 | -1463<br>399<br>-701 | 2143<br>106<br>-1378 | -2122<br>-626<br>* | -586<br>210<br>* | -2233<br>-466 | -1445<br>-720 | -688<br>275 | 2941<br>394 | -560<br>45 | -941<br>96 | 855<br>359 | -805<br>117 | -1657<br>-369 | -2369<br>-294 | -1763<br>-249 | 163 |
| 158(G) | -2594<br>-149<br>-16 | -2690<br>-500<br>-7108 | -3304<br>233<br>-8150 | -3623<br>43<br>-894 | -4328<br>-381<br>-1115 | 3747<br>399<br>-701 | -3462<br>106<br>-1378 | -4761<br>-626<br>* | -3953<br>210<br>* | -4671<br>-466 | -4212<br>-720 | -3320<br>275 | -3352<br>394 | -3748<br>45 | -3779<br>96 | -2839<br>359 | -2981<br>117 | 4004<br>-369 | -3668<br>-294 | -4222<br>-249 | 164 |
| 159(H) | -744<br>-149<br>-16 | -2193<br>-500<br>-7108 | -114<br>233<br>-8150 | 1118<br>43<br>-894 | -2513<br>-381<br>-1115 | -1512<br>399<br>-701 | 2486<br>106<br>-1378 | -2252<br>-626<br>* | 1178<br>210<br>* | -2183<br>-466 | -1308<br>-720 | 2230<br>275 | -1689<br>394 | 180<br>45 | -233<br>96 | -598<br>359 | -687<br>117 | -1823<br>-369 | -2335<br>-294 | -1670<br>-249 | 165 |
| 160(W) | -2672<br>-149<br>-16 | -2139<br>-500<br>-7108 | -3850<br>233<br>-8150 | -3748<br>43<br>-894 | 941<br>-381<br>-1115 | 3611<br>399<br>-701 | -469<br>106<br>-1378 | -1691<br>-626<br>* | -3306<br>210<br>* | 1047<br>-466 | -1217<br>-720 | -2551<br>275 | -3534<br>394 | -2514<br>45 | -2960<br>96 | -2788<br>359 | -2577<br>117 | -1799<br>-369 | 4205<br>-294 | 3466<br>-249 | 166 |
| 161(K) | 386<br>-149<br>-16 | -1981<br>-500<br>-7108 | 779<br>233<br>-8150 | 279<br>43<br>-894 | -2295<br>-381<br>-1115 | -1403<br>399<br>-701 | -114<br>106<br>-1378 | -2043<br>-626<br>* | 2059<br>210<br>* | -1991<br>-466 | -1082<br>-720 | 941<br>275 | -1536<br>394 | 1263<br>45 | -211<br>96 | -384<br>359 | 457<br>117 | -1602<br>-369 | -2161<br>-294 | -1476<br>-249 | 167 |
| 162(G) | -2594<br>-149<br>-16 | -2690<br>-500<br>-7108 | -3304<br>233<br>-8150 | -3623<br>43<br>-894 | -4328<br>-381<br>-1115 | 3747<br>399<br>-701 | -3462<br>106<br>-1378 | -4761<br>-626<br>* | -3953<br>210<br>* | -4671<br>-466 | -4212<br>-720 | -3320<br>275 | -3352<br>394 | -3748<br>45 | -3779<br>96 | -2839<br>359 | -2981<br>117 | 4004<br>-369 | -3668<br>-294 | -4222<br>-249 | 168 |
| 163(K) | -1144<br>-149<br>-16 | -2365<br>-500<br>-7108 | -912<br>233<br>-8150 | 2048<br>43<br>-894 | -2856<br>-381<br>-1115 | -1912<br>399<br>-701 | -326<br>106<br>-1378 | -2459<br>-626<br>* | 2267<br>210<br>* | -2295<br>-466 | -1482<br>-720 | -556<br>275 | -1989<br>394 | 108<br>45 | 1334<br>96 | -1013<br>359 | -1014<br>117 | -2093<br>-369 | -2324<br>-294 | -1881<br>-249 | 169 |

TABLE 6-continued

| | | | | | | | | | | | | | | | | | | |
|---|---|---|---|---|---|---|---|---|---|---|---|---|---|---|---|---|---|---|
| 164(D) | -1091 | -2610 | 2941 | 174 | -2957 | -1527 | -595 | -2750 | 1084 | -2696 | -1877 | -176 | -1885 | -206 | -1006 | 740 | -1098 | -2288 | -2880 | -2105 | 170 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 165(L) | -2387 | -1922 | -4674 | -4155 | -617 | -4366 | -3250 | 1889 | -3865 | 2650 | 558 | -4023 | -3847 | -3098 | -3586 | -3647 | -2296 | -38 | -2247 | -2224 | 171 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 166(N) | -1021 | -2427 | 1806 | 133 | -2870 | -1499 | -635 | -2647 | -521 | -2640 | -1825 | 2171 | -1874 | -255 | -1124 | -860 | 2122 | -2184 | -2853 | -2090 | 172 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 167(I) | -1830 | -1390 | -4327 | -3873 | -1210 | -3994 | -3274 | 2967 | -3678 | 1259 | -30 | -3633 | -3730 | -3283 | -3604 | -3249 | -1791 | 1570 | -2661 | -2417 | 173 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 168(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -2677 | 174 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 169(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 175 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 170(A) | -824 | -2371 | 2082 | -894 | -1993 | -1344 | -1704 | -1264 | -1899 | -1832 | -1137 | -1517 | -1946 | -1674 | -2005 | 1075 | -641 | 1474 | -2390 | -2055 | 176 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 171(F) | -3342 | -2776 | -4026 | -4232 | 4354 | -3545 | -1431 | -2315 | -4038 | -1801 | -1900 | -3299 | -3780 | -3350 | -3645 | -3490 | -3420 | -2566 | -739 | 349 | 177 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 172(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 178 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 173(A) | -1031 | -2429 | -2551 | -894 | -3222 | 1554 | -2368 | -2934 | -2633 | -3225 | -2377 | -1727 | -2028 | -2309 | -2637 | -656 | -850 | -1980 | -3412 | -3224 | 179 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 174(V) | -1342 | -4255 | -3793 | -1216 | -3901 | -3162 | 1633 | -3589 | 1486 | -51 | -3537 | -3667 | -3214 | -3518 | -3143 | -1731 | 2692 | -2609 | -2345 | | 180 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 175(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 181 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | |
|---|---|---|---|---|---|---|---|---|---|---|---|---|---|---|---|---|---|---|
| 176(Q) | -729 -149 -16 | -2116 -500 -7108 | -413 233 -8150 | 1096 43 -894 | -2484 -381 -1115 | -1587 399 -701 | 1599 106 -1378 | -2186 -626 * | 1695 210 * | -2094 -466 | -1219 -720 | -223 275 | -1698 394 | -2418 45 | 90 96 | -599 359 | -649 117 | -1770 -369 | -2213 -294 | -1615 -249 | 182 |
| 177(W) | -1652 -149 -16 | -1707 -500 -7108 | -2340 233 -8150 | -1879 43 -894 | 1996 -381 -1115 | -2733 399 -701 | 2013 106 -1378 | -1398 -626 * | 1758 210 * | -1386 -466 | -938 -720 | -1641 275 | -2751 394 | -1364 45 | -1762 96 | -1780 359 | -1577 117 | -1325 -369 | 3577 -294 | 2136 -249 | 183 |
| 178(T) | -421 -149 -16 | -753 -500 -7108 | -1251 233 -8150 | -704 43 -894 | -846 -381 -1115 | -1670 399 -701 | -535 106 -1378 | 894 -626 * | -548 210 * | -690 -466 | -1 -720 | 1376 275 | -1791 394 | 421 45 | -846 96 | 373 359 | 1461 117 | 858 -369 | -1236 -294 | -812 -249 | 184 |
| 179(H) | 1498 -149 -16 | -1593 -500 -7108 | -504 233 -8150 | 15 43 -894 | -1895 -381 -1115 | -1484 399 -701 | 2279 106 -1378 | -1559 -626 * | 1119 210 * | -1640 -466 | -810 -720 | -242 275 | -1611 394 | 194 45 | -171 96 | -462 359 | 815 117 | -1231 -369 | -1914 -294 | -1340 -249 | 185 |
| 180(G) | -1515 -149 -16 | -2130 -500 -7108 | -1298 233 -8150 | -1450 43 -894 | -2658 -381 -1115 | 3285 399 -701 | 2212 106 -1378 | -3276 -626 * | -1691 210 * | -3291 -466 | -2638 -720 | -1524 275 | -2562 394 | -1662 45 | -1925 96 | -1600 359 | -1764 117 | -2713 -369 | -2804 -294 | -2234 -249 | 186 |
| 181(K) | -528 -149 -16 | -2010 -500 -7108 | 1346 233 -8150 | 1082 43 -894 | -2329 -381 -1115 | -1408 399 -701 | -118 106 -1378 | -2080 -626 * | 1475 210 * | -2018 -466 | -1108 -720 | 1161 275 | -1543 394 | 331 45 | 1052 96 | -394 359 | 471 117 | -1632 -369 | -2181 -294 | -1494 -249 | 187 |
| 182(M) | -1894 -149 -16 | -1521 -500 -7108 | -4170 233 -8150 | -3679 43 -894 | -840 -381 -1115 | -3793 399 -701 | -2866 106 -1378 | 2827 -626 * | -3360 210 * | 375 -466 | 3445 -720 | -3437 275 | -3555 394 | -2902 45 | -3223 96 | -3028 359 | -1846 117 | 470 -369 | -2249 -294 | -2059 -249 | 188 |
| 183(T) | -670 -149 -16 | -1758 -500 -7108 | 1731 233 -8150 | -141 43 -894 | -2591 -381 -1115 | -1399 399 -701 | -691 106 -1378 | -2319 -626 * | -499 210 * | -2384 -466 | -1543 -720 | -387 275 | -1786 394 | -316 45 | -1016 96 | 1576 359 | 2044 117 | -1811 -369 | -2624 -294 | -1981 -249 | 189 |
| 184(E) | 345 -149 -16 | -2074 -500 -7108 | 925 233 -8150 | 1994 43 -894 | -2378 -381 -1115 | -1408 399 -701 | -177 106 -1378 | -2135 -626 * | 922 210 * | -2084 -466 | -1183 -720 | -38 275 | 641 394 | 264 45 | -356 96 | -444 359 | -536 117 | -1690 -369 | -2261 -294 | -1556 -249 | 190 |
| 185(E) | -1493 -149 -16 | -2900 -500 -7108 | 93 233 -8150 | 3374 43 -894 | -2903 -381 -1115 | -1743 399 -701 | 1987 106 -1378 | -3042 -626 * | -646 210 * | -2957 -466 | -2238 -720 | 411 275 | -2146 394 | -506 45 | -1121 96 | -1272 359 | -1503 117 | -2629 -369 | -2905 -294 | -2134 -249 | 191 |
| 186(D) | -1293 -149 -16 | -2959 -500 -7108 | 2673 233 -8150 | 2121 43 -894 | -3219 -381 -1115 | -1546 399 -701 | -713 106 -1378 | -3043 -626 * | -707 210 * | -2974 -466 | -2191 -720 | -158 275 | -1967 394 | -342 45 | -1394 96 | -1043 359 | 701 117 | -2567 -369 | -3172 -294 | -2311 -249 | 192 |
| 187(F) | -1137 -149 -16 | -905 -500 -7108 | -3250 233 -8150 | -2707 43 -894 | 2365 -381 -1115 | -2647 399 -701 | -1016 106 -1378 | -34 -626 * | -2336 210 * | 1239 -466 | 267 -720 | -2150 275 | -2626 394 | -1861 45 | -2133 96 | -1752 359 | -1069 117 | 1461 -369 | -599 -294 | 1844 -249 | 193 |

TABLE 6-continued

| | | | | | | | | | | | | | | | | | | |
|---|---|---|---|---|---|---|---|---|---|---|---|---|---|---|---|---|---|---|
| 188(K) | -479 | -1713 | -409 | 1031 | -1925 | -1467 | 1755 | -1650 | 1844 | -349 | -827 | -140 | -1556 | 319 | -75 | -403 | -411 | -1301 | -1900 | 843 | 194 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | | | |
| 189(G) | 433 | -2144 | 52 | 1047 | -2717 | 2393 | -615 | -2467 | -442 | -2482 | -1655 | 1123 | -1828 | -233 | -995 | -763 | -923 | -2000 | -2710 | -2005 | 195 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | | | |
| 190(V) | -1752 | -1320 | -4524 | -3806 | -1311 | -3916 | -3232 | 1701 | -3614 | 1188 | -140 | -3551 | -3693 | -3280 | -3568 | -3166 | -1718 | 2833 | -2703 | -2409 | 196 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | | | |
| 191(E) | -1199 | -1750 | -734 | 2668 | -1820 | -2038 | -1068 | 1892 | -867 | -1273 | -897 | -922 | -2295 | -797 | -1238 | -1340 | -1197 | -426 | -2325 | -1789 | 197 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | | | |
| 192(C) | -1182 | 3528 | -1398 | -620 | -2541 | -2038 | -358 | -2093 | 1181 | -2037 | -1272 | -747 | -2070 | 1553 | 2213 | -1123 | -1038 | -1817 | -2142 | -1774 | 198 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | | | |
| 193(N) | -1478 | -2527 | -261 | -403 | -2011 | -1837 | 2032 | -2925 | -735 | -2845 | -2195 | 3635 | -2259 | -721 | -1085 | -1352 | -1546 | -2522 | -2307 | -1431 | 199 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | | | |
| 194(A) | 3438 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 200 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | | | |
| 195(C) | -1220 | 4911 | -3609 | -3314 | -1440 | -2525 | -2482 | 1565 | -2922 | -706 | -544 | -2678 | -2896 | -2710 | -2836 | -1869 | -1375 | 379 | -2371 | -1957 | 201 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | | | |
| 196(P) | -2931 | -2878 | -3420 | -3706 | -4181 | -2925 | -3468 | -4621 | -3859 | -4490 | -4165 | -3491 | 4225 | -3781 | -3695 | -3182 | -3279 | -4087 | -3594 | -4064 | 202 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | | | |
| 197(G) | -477 | -1115 | -1983 | -2189 | -3315 | 3154 | -2272 | -3172 | -2506 | -3387 | -2522 | -1599 | -2042 | -2177 | -2583 | 1217 | -905 | -2130 | -3477 | -3225 | 203 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | | | |
| 198(A) | 1653 | -1347 | -705 | -249 | -1969 | -1385 | -477 | -1629 | -159 | -1759 | -935 | -434 | 1285 | 1404 | -586 | -450 | 1019 | -1243 | -2070 | -1522 | 204 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | | | |
| 199(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 205 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | | | | | | | | | | | | |

TABLE 6-continued

| | | | | | | | | | | | | | | | | | | | |
|---|---|---|---|---|---|---|---|---|---|---|---|---|---|---|---|---|---|---|---|
| 200(S) | 1870 -149 -16 | -938 -500 -7108 | -2270 233 -8150 | -2183 43 -894 | -3068 -381 -1115 | 1488 399 -701 | -2056 106 -1378 | -2810 -626 * | -2168 210 * | -3032 -466 | -2144 -720 | -1511 275 | -1898 394 | -1901 45 | -2300 96 | 2236 359 | -690 117 | -1857 -369 | -3265 -294 | -2990 -249 | 206 |
| 201(C) | -2476 -149 -16 | 3735 -500 -7108 | -4102 233 -8150 | -4358 43 -894 | -3712 -381 -1115 | -2763 399 -701 | -3545 106 -1378 | -3518 -626 * | -4167 210 * | -3859 -466 | -3569 -720 | -3631 275 | -3363 394 | -4030 45 | -3832 96 | -2793 359 | -2860 117 | -3158 -369 | -3464 -294 | -3718 -249 | 207 |
| 202(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 208 |
| 203(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 209 |
| 204(M) | -2406 -149 -16 | -2296 -500 -7108 | -3638 233 -8150 | -3594 43 -894 | -1525 -381 -1115 | -3105 399 -701 | -2824 106 -1378 | -1047 -626 * | -3121 210 * | -596 -466 | 5043 -720 | -3293 275 | -3425 394 | -3046 45 | -2996 96 | -2911 359 | -2552 117 | -1398 -369 | -2513 -294 | -2207 -249 | 210 |
| 205(Y) | -3590 -149 -16 | -2700 -500 -7108 | -4146 233 -8150 | -4379 43 -894 | 2092 -381 -1115 | -4028 399 -701 | -404 106 -1378 | -2517 -626 * | -3963 210 * | -1928 -466 | -1973 -720 | -2744 275 | -3921 394 | -2845 45 | -3431 96 | -3284 359 | -3474 117 | -2669 -369 | 336 -294 | 4423 -249 | 211 |
| 206(T) | -1213 -149 -16 | -1674 -500 -7108 | -2755 233 -8150 | -2906 43 -894 | -3163 -381 -1115 | -1922 399 -701 | -2659 106 -1378 | -2698 -626 * | -2788 210 * | -3105 -466 | -2612 -720 | -2311 275 | -2600 394 | -2708 45 | -2753 96 | -1463 359 | 3819 117 | -2197 -369 | -3286 -294 | -3156 -249 | 212 |
| 207(A) | 3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 213 |
| 208(N) | -2171 -149 -16 | -2655 -500 -7108 | -1458 233 -8150 | -1748 43 -894 | -3334 -381 -1115 | -2364 399 -701 | -2267 106 -1378 | -3943 -626 * | -2365 210 * | -3936 -466 | -3437 -720 | 4205 275 | -2932 394 | -2205 45 | -2608 96 | -2224 359 | -2439 117 | -3392 -369 | -3253 -294 | -2909 -249 | 214 |
| 209(T) | -1213 -149 -16 | -1674 -500 -7108 | -2755 233 -8150 | -2906 43 -894 | -3163 -381 -1115 | -1922 399 -701 | -2659 106 -1378 | -2698 -626 * | -2788 210 * | -3105 -466 | -2612 -720 | -2311 275 | -2600 394 | -2708 45 | -2753 96 | -1463 359 | 3819 117 | -2197 -369 | -3286 -294 | -3156 -249 | 215 |
| 210(M) | -2355 -149 -16 | -1988 -500 -7108 | -4343 233 -8150 | -3834 43 -894 | -504 -381 -1115 | -4051 399 -701 | -2868 106 -1378 | 105 -626 * | -3385 210 * | 1451 -466 | 4460 -720 | -3680 275 | -3671 394 | -2806 45 | -3171 96 | -3327 359 | -2274 117 | -474 -369 | -2039 -294 | -1925 -249 | 216 |
| 211(S) | 2150 -149 -16 | -939 -500 -7108 | -2407 233 -8150 | -2415 43 -894 | -3075 -381 -1115 | -1197 399 -701 | -2205 106 -1378 | -2781 -626 * | -2384 210 * | -3065 -466 | -2205 -720 | -1613 275 | -1936 394 | -2105 45 | -2436 96 | 2653 359 | -729 117 | -1850 -369 | -3306 -294 | -3049 -249 | 217 |

TABLE 6-continued

| | | | | | | | | | | | | | | | | | | |
|---|---|---|---|---|---|---|---|---|---|---|---|---|---|---|---|---|---|---|
| 212(S) | -344 | -979 | -2190 | -2162 | -2959 | -1227 | -2042 | -2651 | -2116 | -2934 | -2100 | -1526 | -1941 | -1909 | -2222 | 2940 | 1775 | -1804 | -3187 | -2882 | 218 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 213(A) | 3048 | -932 | -2480 | -2533 | -3075 | -1200 | -2274 | -2765 | -2501 | -3071 | -2221 | -1658 | -1948 | -2205 | -2512 | 1225 | -739 | -1842 | -3322 | -3078 | 219 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 214(I) | -1924 | -1546 | -4067 | -3658 | 2312 | -3663 | -2081 | 3030 | -3367 | 150 | 99 | -3197 | -3492 | -2821 | -3179 | -2894 | -1877 | 293 | -1445 | -692 | 220 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 215(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 221 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 216(A) | 2389 | -814 | -2506 | -2162 | -1696 | -1545 | -1698 | -499 | -1942 | -1398 | -813 | -1640 | -2076 | -1723 | -2027 | -806 | 1148 | 1559 | -2200 | -1856 | 222 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 217(M) | -2576 | -2118 | -4725 | -4165 | -461 | -4430 | -3165 | 99 | -3811 | 2513 | 3434 | -4075 | -3839 | -2978 | -3488 | -3704 | -2457 | -591 | -2111 | -2145 | 223 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 218(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 224 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 219(M) | -2313 | -1968 | -4258 | -3765 | -518 | -3966 | -2806 | 98 | -3289 | 1292 | 4523 | -3599 | -3636 | -2769 | -3097 | -3249 | -2243 | -457 | -2026 | -1874 | 225 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 220(S) | -897 | -1462 | -2333 | -2543 | -3185 | -1640 | -2474 | -3294 | -2686 | -3497 | -2780 | -1973 | -2360 | -2483 | -2703 | -3465 | -1316 | -2413 | -3310 | -3025 | 226 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 221(L) | -2631 | -2159 | -4786 | -4228 | -462 | -4506 | -3231 | 96 | -3878 | 2828 | 2482 | -4157 | -3880 | -3016 | -3541 | -3793 | -2509 | -608 | -2134 | -2182 | 227 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 222(P) | -1501 | -1778 | -2473 | -2371 | -1710 | -2311 | -2045 | -1321 | -2060 | 827 | -1068 | -2173 | 3594 | -2082 | -2130 | -1799 | -1699 | -1373 | -2373 | -1942 | 228 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 223(Y) | -1068 | -1670 | -865 | -836 | -631 | 1198 | -767 | -1828 | -1059 | -1914 | -1304 | 692 | -2203 | -906 | -1387 | -1136 | -1163 | -1566 | -1185 | 3760 | 229 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |

TABLE 6-continued

| | | | | | | | | | | | | | | | | | | |
|---|---|---|---|---|---|---|---|---|---|---|---|---|---|---|---|---|---|---|
| 224(S) | -897 | -1462 | -2333 | -2543 | -3185 | -1640 | -2474 | -3294 | -2686 | -3497 | -2780 | -1973 | -2360 | -2483 | -2703 | 3465 | -1316 | -2413 | -3310 | -3025 | 230 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 225(S) | 1172 | -954 | -2367 | -2422 | -3120 | -1204 | -2237 | -2835 | -2426 | -3122 | -2265 | -1621 | -1948 | -2145 | -2467 | 3107 | -749 | -1884 | -3349 | -3092 | 231 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 226(S) | -342 | -975 | -2176 | -2124 | -2912 | -1229 | -2003 | -2594 | -2067 | -2878 | -2048 | -1510 | -1936 | -1866 | -2184 | 2553 | 2492 | -1773 | -3143 | -2833 | 232 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 227(M) | -720 | -1440 | -710 | -343 | -1228 | -1693 | 2436 | -1209 | -132 | -1364 | 3099 | 1904 | -1852 | -183 | -458 | -776 | -680 | -1004 | -1540 | -890 | 233 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 228(P) | 2240 | -1100 | -2241 | -2293 | -3037 | -1346 | -2188 | -2683 | -2317 | -2986 | -2210 | -1663 | 3041 | -2093 | -2391 | -722 | -895 | -1893 | -3243 | -2998 | 234 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 229(A) | 2958 | -1235 | -1299 | -1377 | -2868 | -1345 | -1673 | -2580 | -1661 | -2843 | -2054 | 1555 | -1995 | -1468 | -1921 | -715 | -888 | -1871 | -3064 | -2360 | 235 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 230(E) | -509 | -1046 | -884 | 1564 | -1116 | -1669 | -441 | -485 | -283 | 250 | -206 | -577 | 689 | -200 | -656 | -670 | 459 | 1290 | -1467 | -995 | 236 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 231(D) | -1203 | -2412 | 2595 | -117 | -3286 | -1536 | -1057 | -3176 | -1165 | -3186 | -2436 | -428 | -2068 | -736 | -1824 | 2377 | -1366 | -2578 | -3334 | -2552 | 237 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 232(Q) | 954 | -1983 | -100 | 971 | -2337 | 177 | -267 | -2067 | 81 | -2060 | -1189 | -125 | -1637 | 2600 | 418 | -514 | -597 | -1649 | -2268 | -1597 | 238 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 233(E) | -2641 | -3308 | -896 | 3732 | -3966 | -2458 | -2043 | -4105 | -2128 | -4016 | -3555 | -1531 | -2959 | -1842 | -2560 | -2479 | -2750 | -3722 | -3563 | -3385 | 239 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 234(K) | -2620 | -2961 | -2461 | -2046 | -3743 | -2791 | -1570 | -3603 | 3784 | -3387 | -2839 | -2048 | -3039 | -1260 | -465 | -2604 | -2536 | -3331 | -3001 | -2988 | 240 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |
| 235(R) | 377 | -1802 | -415 | 988 | -2095 | -1474 | -95 | -1786 | 1452 | -1785 | -911 | -135 | -1560 | 343 | 3555 | -409 | -431 | 376 | -1986 | -1375 | 241 |
| - | -149 | -500 | 233 | 43 | -381 | 399 | 106 | -626 | 210 | -466 | -720 | 275 | 394 | 45 | 96 | 359 | 117 | -369 | -294 | -249 |
| - | -16 | -7108 | -8150 | -894 | -1115 | -701 | -1378 | * | * | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 236(D) | 1083 -149 -16 | -1565 -500 -7108 | 2662 233 -8150 | -244 43 -894 | -1941 -381 -1115 | -1573 399 -701 | -679 106 -1378 | 612 -626 * | -527 210 * | -1651 -466 | -980 -720 | -490 275 | -1869 394 | -358 45 | -1003 96 | -771 359 | -766 117 | -903 -369 | -2208 -294 | -1633 -249 | 242 |
| 237(E) | -1225 -149 -16 | -2868 -500 -7108 | 1894 233 -8150 | 1948 43 -894 | -3149 -381 -1115 | -1532 399 -701 | -671 106 -1378 | -2975 -626 * | -630 210 * | -2902 -466 | -2101 -720 | -150 275 | -1935 394 | -293 45 | -1299 96 | 1884 359 | -1241 117 | -2496 -369 | -3093 -294 | -2248 -249 | 243 |
| 238(C) | 1375 -149 -16 | 3262 -500 -7108 | -2620 233 -8150 | -2108 43 -894 | -827 -381 -1115 | -1866 399 -701 | -1267 106 -1378 | 1631 -626 * | -1811 210 * | -599 -466 | -10 -720 | -1674 275 | -2137 394 | -1531 45 | -1786 96 | -1034 359 | 790 117 | 249 -369 | -1361 -294 | -1010 -249 | 244 |
| 239(E) | 635 -149 -16 | -1796 -500 -7108 | 1055 233 -8150 | 1761 43 -894 | -2018 -381 -1115 | -1464 399 -701 | -263 106 -1378 | 1191 -626 * | 28 210 * | -1767 -466 | -946 -720 | -148 275 | -1637 394 | 135 45 | -481 96 | -520 359 | -553 117 | -1300 -369 | -2077 -294 | -1441 -249 | 245 |
| 240(E) | 593 -149 -16 | -2044 -500 -7108 | -252 233 -8150 | 2548 43 -894 | -2437 -381 -1115 | -1542 399 -701 | -329 106 -1378 | -2133 -626 * | 151 210 * | -2120 -466 | -1274 -720 | -244 275 | -1738 394 | 89 45 | 946 96 | -646 359 | -717 117 | -1734 -369 | -2305 -294 | -1686 -249 | 246 |
| 241(S) | 1884 -149 -16 | -835 -500 -7108 | -1962 233 -8150 | -1576 43 -894 | -1634 -381 -1115 | -1436 399 -701 | -1320 106 -1378 | 1041 -626 * | -1409 210 * | -1453 -466 | -781 -720 | -1293 275 | -1922 394 | -1241 45 | -1606 96 | 1973 359 | -597 117 | -669 -369 | -2036 -294 | -1656 -249 | 247 |
| 242(G) | 2267 -149 -16 | -1043 -500 -7108 | -2388 233 -8150 | -2526 43 -894 | -3253 -381 -1115 | 2642 399 -701 | -2373 106 -1378 | -2975 -626 * | -2639 210 * | -3260 -466 | -2410 -720 | -1722 275 | -2033 394 | -2311 45 | -2648 96 | -663 359 | -860 117 | -2005 -369 | -3436 -294 | -3250 -249 | 248 |
| 243(R) | -876 -149 -16 | -2087 -500 -7108 | -829 233 -8150 | 1490 43 -894 | -2474 -381 -1115 | -1766 399 -701 | -229 106 -1378 | -2106 -626 * | 1269 210 * | -44 -466 | -1198 -720 | -424 275 | -1829 394 | 205 45 | 2225 96 | -775 359 | -768 117 | -1753 -369 | -2143 -294 | -1647 -249 | 249 |
| 244(V) | 2339 -149 -16 | -967 -500 -7108 | -2970 233 -8150 | -2766 43 -894 | -1878 -381 -1115 | -1847 399 -701 | -2252 106 -1378 | 32 -626 * | -2541 210 * | -1299 -466 | -918 -720 | -2087 275 | -2399 394 | -2316 45 | -2545 96 | -1157 359 | -971 117 | 2345 -369 | -2605 -294 | -2251 -249 | 250 |
| 245(I) | -1827 -149 -16 | -1398 -500 -7108 | -4307 233 -8150 | -3831 43 -894 | -1099 -381 -1115 | -3939 399 -701 | -3142 106 -1378 | 2286 -626 * | -3619 210 * | 1835 -466 | 69 -720 | -3579 275 | -3671 394 | -3177 45 | -3511 96 | -3178 359 | -1781 117 | 1918 -369 | -2524 -294 | -2310 -249 | 251 |
| 246(V) | -1178 -149 -16 | -1448 -500 -7108 | -1943 233 -8150 | -1452 43 -894 | -1776 -381 -1115 | -2261 399 -701 | -1140 106 -1378 | -227 -626 * | 1866 210 * | -1260 -466 | -816 -720 | -1444 275 | -2448 394 | -902 45 | -540 96 | -1496 359 | -1176 117 | 2697 -369 | -2161 -294 | -1764 -249 | 252 |
| 247(E) | -508 -149 -16 | -1976 -500 -7108 | 840 233 -8150 | 1547 43 -894 | -2280 -381 -1115 | -1393 399 -701 | -117 106 -1378 | -2029 -626 * | 1400 210 * | -1984 -466 | -1077 -720 | 1158 275 | -1531 394 | 330 45 | -253 96 | -378 359 | 454 117 | 262 -369 | -2163 -294 | -1471 -249 | 253 |

TABLE 6-continued

| | | | | | | | | | | | | | | | | | | |
|---|---|---|---|---|---|---|---|---|---|---|---|---|---|---|---|---|---|---|
| 248(M) | 1703 -149 -16 | -991 -500 -7108 | -2901 233 -8150 | -2342 43 -894 | -528 -381 -1115 | -2567 399 -701 | -1550 106 -1378 | 166 -626 * | -2031 210 * | 1544 -466 | 2668 -720 | -2104 275 | -2591 394 | -1715 45 | -2010 96 | -1685 359 | -1052 117 | -12 -369 | -1442 -294 | -1177 -249 | 254 |
| 249(I) | -1947 -149 -16 | -1516 -500 -7108 | -4385 233 -8150 | -3885 43 -894 | -916 -381 -1115 | -4013 399 -701 | -3118 106 -1378 | 2193 -626 * | -3656 210 * | 2186 -466 | 257 -720 | -3656 275 | -3687 394 | -3109 45 | -3494 96 | -3250 359 | -1889 117 | 1383 -369 | -2397 -294 | -2258 -249 | 255 |
| 250(E) | -1322 -149 -16 | -2647 -500 -7108 | -272 233 -8150 | 2491 43 -894 | -3071 -381 -1115 | -1811 399 -701 | -576 106 -1378 | -2759 -626 * | 2306 210 * | -2633 -466 | -1854 -720 | -464 275 | -2066 394 | -175 45 | -177 96 | -1144 359 | -1256 117 | -2368 -369 | -2692 -294 | -2140 -249 | 256 |
| 251(K) | -1395 -149 -16 | -2059 -500 -7108 | -1711 233 -8150 | -1014 43 -894 | -2215 -381 -1115 | -2218 399 -701 | -641 106 -1378 | -1709 -626 * | 3022 210 * | -1652 -466 | 2578 -720 | -1075 275 | -2303 394 | -282 45 | 287 96 | -1423 359 | -1283 117 | -1603 -369 | -2159 -294 | -1803 -249 | 257 |
| 252(D) | -1285 -149 -16 | -2888 -500 -7108 | 2677 233 -8150 | 176 43 -894 | -3210 -381 -1115 | 1189 399 -701 | -737 106 -1378 | -3047 -626 * | -715 210 * | -2977 -466 | -2195 -720 | -190 275 | -1979 394 | 2106 45 | -1379 96 | -1050 359 | -1315 117 | -2564 -369 | -3161 -294 | -2320 -249 | 258 |
| 253(I) | -2073 -149 -16 | -1632 -500 -7108 | -4434 233 -8150 | -3975 43 -894 | -911 -381 -1115 | -4130 399 -701 | -3238 106 -1378 | 3164 -626 * | -3706 210 * | 1451 -466 | 244 -720 | -3779 275 | -3785 394 | -3187 45 | -3557 96 | -3413 359 | -2021 117 | 546 -369 | -2449 -294 | -2273 -249 | 259 |
| 254(K) | -1570 -149 -16 | -2144 -500 -7108 | -1887 233 -8150 | -1191 43 -894 | -2098 -381 -1115 | -2363 399 -701 | -750 106 -1378 | -1603 -626 * | 3034 210 * | 938 -466 | -1112 -720 | -1231 275 | -2436 394 | -408 45 | 215 96 | -1616 359 | -1443 117 | -1580 -369 | -2166 -294 | -1804 -249 | 260 |
| 255(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 261 |
| 256(R) | -928 -149 -16 | -1705 -500 -7108 | -1507 233 -8150 | -1055 43 -894 | -2761 -381 -1115 | -1730 399 -701 | -896 106 -1378 | -2490 -626 * | -44 210 * | -2489 -466 | -1723 -720 | -1042 275 | -2102 394 | -543 45 | 2614 96 | 2258 359 | -1053 117 | -1998 -369 | -2546 -294 | -2158 -249 | 262 |
| 257(D) | -1280 -149 -16 | -2865 -500 -7108 | 3154 233 -8150 | 175 43 -894 | -3194 -381 -1115 | -1547 399 -701 | -743 106 -1378 | -3034 -626 * | -728 210 * | -2971 -466 | -2194 -720 | -190 275 | -1979 394 | 1342 45 | -1391 96 | 553 359 | -1316 117 | -2552 -369 | -3161 -294 | -2317 -249 | 263 |
| 258(I) | -1997 -149 -16 | -1562 -500 -7108 | -4355 233 -8150 | -3927 43 -894 | -1042 -381 -1115 | -4066 399 -701 | -3261 106 -1378 | 3343 -626 * | -3654 210 * | 937 -466 | 97 -720 | -3718 275 | -3783 394 | -3239 45 | -3555 96 | -3364 359 | -1959 117 | 702 -369 | -2549 -294 | -2295 -249 | 264 |
| 259(M) | -2252 -149 -16 | -1821 -500 -7108 | -4572 233 -8150 | -3991 43 -894 | -530 -381 -1115 | -4164 399 -701 | -2990 106 -1378 | 2068 -626 * | -3709 210 * | 1993 -466 | 3197 -720 | -3808 275 | -3685 394 | -2916 45 | -3406 96 | -3378 359 | -2149 117 | -172 -369 | -2084 -294 | -2091 -249 | 265 |

TABLE 6-continued

| | | | | | | | | | | | | | | | | |
|---|---|---|---|---|---|---|---|---|---|---|---|---|---|---|---|---|
| 260(T) | -1213 -149 -16 | -1674 -500 -7108 | -2755 233 -8150 | -2906 43 -894 | -3163 -381 -1115 | -1922 399 -701 | -2659 106 -1378 | -2698 -626 * | -2788 210 * | -3105 -466 | -2612 -720 | -2311 275 | -2600 394 | -2708 45 | -2753 96 | -1463 359 | -3819 117 | -2197 -369 | -3286 -294 | -3156 -249 | 266 |
| 261(R) | -2131 -149 -16 | -2786 -500 -7108 | -2704 233 -8150 | -1460 43 -894 | -3618 -381 -1115 | -2638 399 -701 | -587 106 -1378 | -2976 -626 * | 1735 210 * | -2645 -466 | -1985 -720 | -1353 275 | -2603 394 | -173 45 | -3492 96 | -2020 359 | -1828 117 | -2748 -369 | -2484 -294 | -2384 -249 | 267 |
| 262(K) | -1349 -149 -16 | -2635 -500 -7108 | -381 233 -8150 | 2083 43 -894 | -3083 -381 -1115 | -1857 399 -701 | -565 106 -1378 | -2750 -626 * | -2600 210 * | -2612 -466 | -1837 -720 | -514 275 | -2090 394 | -161 45 | -61 96 | -1178 359 | -1271 117 | -2369 -369 | -2655 -294 | -2138 -249 | 268 |
| 263(A) | -2821 -149 -16 | -932 -500 -7108 | -2451 233 -8150 | -2472 43 -894 | -3065 -381 -1115 | -1198 399 -701 | -2233 106 -1378 | -2763 -626 * | -2434 210 * | -3056 -466 | -2201 -720 | -1633 275 | -1940 394 | -2147 45 | -2468 96 | 1831 359 | -730 117 | -1840 -369 | -3305 -294 | -3055 -249 | 269 |
| 264(F) | -2063 -149 -16 | -1686 -500 -7108 | -4037 233 -8150 | -3677 43 -894 | -3437 -381 -1115 | -3644 399 -701 | -1706 106 -1378 | 2063 -626 * | -3359 210 * | 135 -466 | 67 -720 | -3095 275 | -3486 394 | -2739 45 | -3127 96 | -2876 359 | -2012 117 | -83 -369 | -1038 -294 | -158 -249 | 270 |
| 265(E) | -2641 -149 -16 | -3308 -500 -7108 | -896 233 -8150 | -3732 43 -894 | -3966 -381 -1115 | -2458 399 -701 | -2043 106 -1378 | -4105 -626 * | -2128 210 * | -4016 -466 | -3555 -720 | -1531 275 | -2959 394 | -1842 45 | -2560 96 | -2479 359 | -2750 117 | -3722 -369 | -3563 -294 | -3385 -249 | 271 |
| 266(N) | -1662 -149 -16 | -3306 -500 -7108 | 2055 233 -8150 | 78 43 -894 | -3621 -381 -1115 | -1643 399 -701 | -1040 106 -1378 | -3622 -626 * | -1272 210 * | -3531 -466 | -2870 -720 | -3477 275 | -2182 394 | -724 45 | -2071 96 | -1371 359 | -1757 117 | -3092 -369 | -3633 -294 | -2700 -249 | 272 |
| 267(A) | -3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 273 |
| 268(I) | -1760 -149 -16 | -1307 -500 -7108 | -4325 233 -8150 | -3962 43 -894 | -1735 -381 -1115 | -4042 399 -701 | -3726 106 -1378 | -3135 -626 * | -3828 210 * | -579 -466 | -515 -720 | -3722 275 | -3869 394 | -3673 45 | -3896 96 | -3359 359 | -1752 117 | 2276 -369 | -3240 -294 | -2806 -249 | 274 |
| 269(T) | 1428 -149 -16 | -904 -500 -7108 | -2334 233 -8150 | -2158 43 -894 | -2747 -381 -1115 | -1206 399 -701 | -1940 106 -1378 | -2392 -626 * | -2037 210 * | -2678 -466 | -1846 -720 | -1504 275 | -1896 394 | -1809 45 | -2163 96 | 902 359 | -3001 117 | -1635 -369 | -2999 -294 | -2705 -249 | 275 |
| 270(V) | -1745 -149 -16 | -1300 -500 -7108 | -4286 233 -8150 | -3858 43 -894 | -1446 -381 -1115 | -3967 399 -701 | -3370 106 -1378 | 2358 -626 * | -3688 210 * | 852 -466 | -261 -720 | -3606 275 | -3749 394 | -3403 45 | -3673 96 | -3232 359 | -1717 117 | -2643 -369 | -2856 -294 | -2524 -249 | 276 |
| 271(V) | -1404 -149 -16 | -1072 -500 -7108 | -3766 233 -8150 | -3305 43 -894 | -1464 -381 -1115 | -3356 399 -701 | -2696 106 -1378 | 2276 -626 * | -3080 210 * | -616 -466 | -379 -720 | -3001 275 | -3325 394 | -2870 45 | -3091 96 | -2563 359 | 1344 117 | -2521 -369 | -2516 -294 | -2113 -249 | 277 |

TABLE 6-continued

| | | | | | | | | | | | | | | | | | | |
|---|---|---|---|---|---|---|---|---|---|---|---|---|---|---|---|---|---|---|
| 272(M) | 866 -149 -16 | -1113 -500 -7108 | -2656 233 -8150 | -2412 43 -894 | -1322 -381 -1115 | -1920 399 -701 | -1883 106 -1378 | -487 -626 * | -2061 210 * | -587 -466 | 4451 -720 | -1950 275 | -2387 394 | -1928 45 | -2078 96 | -1220 359 | -1053 117 | -498 -369 | -2134 -294 | -1803 -249 | 278 |
| 273(A) | 2601 -149 -16 | -957 -500 -7108 | -2898 233 -8150 | -2711 43 -894 | -1943 -381 -1115 | -1740 399 -701 | -2211 106 -1378 | -165 -626 * | -2487 210 * | -1406 -466 | -1001 -720 | -2008 275 | -2320 394 | -2260 45 | -2494 96 | -1053 359 | -929 117 | 1990 -369 | -2626 -294 | -2279 -249 | 279 |
| 274(L) | -1171 -149 -16 | -983 -500 -7108 | -3266 233 -8150 | -2733 43 -894 | -796 -381 -1115 | -2795 399 -701 | -1888 106 -1378 | 590 -626 * | -2418 210 * | 2001 -466 | 198 -720 | -2418 275 | -2816 394 | -2106 45 | -2362 96 | -1944 359 | 965 117 | 1777 -369 | -1724 -294 | -1426 -249 | 280 |
| 275(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 281 |
| 276(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 282 |
| 277(S) | -897 -149 -16 | -1462 -500 -7108 | -2333 233 -8150 | -2543 43 -894 | -3185 -381 -1115 | -1640 399 -701 | -2474 106 -1378 | -3294 -626 * | -2686 210 * | -3497 -466 | -2780 -720 | -1973 275 | -2360 394 | -2483 45 | -2703 96 | 3465 359 | -1316 117 | -2413 -369 | -3310 -294 | -3025 -249 | 283 |
| 278(T) | -1213 -149 -16 | -1674 -500 -7108 | -2755 233 -8150 | -2906 43 -894 | -3163 -381 -1115 | -1922 399 -701 | -2659 106 -1378 | -2698 -626 * | -2788 210 * | -3105 -466 | 2612 -720 | -2311 275 | -2600 394 | -2708 45 | -2753 96 | -1463 359 | 3819 117 | -2197 -369 | -3286 -294 | -3156 -249 | 284 |
| 279(N) | -2171 -149 -16 | -2655 -500 -7108 | -1458 233 -8150 | -1748 43 -894 | -3334 -381 -1115 | -2364 399 -701 | -2267 106 -1378 | -3943 -626 * | -2365 210 * | -3936 -466 | -3437 -720 | 4205 275 | -2932 394 | -2205 45 | -2608 96 | -2224 359 | -2439 117 | -3392 -369 | -3253 -294 | -2909 -249 | 285 |
| 280(A) | 3134 -149 -16 | -934 -500 -7108 | -2491 233 -8150 | -2567 43 -894 | -3083 -381 -1115 | -1203 399 -701 | -2300 106 -1378 | -2766 -626 * | -2540 210 * | -3082 -466 | -2237 -720 | -1672 275 | -1954 394 | -2240 45 | -2537 96 | 874 359 | -747 117 | -1844 -369 | -3333 -294 | -3093 -249 | 286 |
| 281(V) | -984 -149 -16 | -1045 -500 -7108 | -3169 233 -8150 | -2909 43 -894 | -1709 -381 -1115 | -2304 399 -701 | -2404 106 -1378 | 531 -626 * | -2643 210 * | -988 -466 | -697 -720 | -2378 275 | -2722 394 | -2480 45 | -2661 96 | -1601 359 | 1504 117 | 3014 -369 | -2588 -294 | -2201 -249 | 287 |
| 282(L) | -2631 -149 -16 | -2159 -500 -7108 | -4786 233 -8150 | -4228 43 -894 | -462 -381 -1115 | -4506 399 -701 | -3231 106 -1378 | 96 -626 * | -3878 210 * | 2838 -466 | 2482 -720 | 4157 275 | -3880 394 | -3016 45 | -3541 96 | -3793 359 | -2509 117 | -608 -369 | -2134 -294 | -2182 -249 | 288 |
| 283(H) | -3205 -149 -16 | -3079 -500 -7108 | -2723 233 -8150 | -2890 43 -894 | -2110 -381 -1115 | -3046 399 -701 | 5295 106 -1378 | -4135 -626 * | -2617 210 * | -3813 -466 | -3561 -720 | -2886 275 | -3482 394 | -2833 45 | -2620 96 | -3291 359 | -3356 117 | -3895 -369 | -2397 -294 | -1681 -249 | 289 |

TABLE 6-continued

| | | | | | | | | | | | | | | | | | | |
|---|---|---|---|---|---|---|---|---|---|---|---|---|---|---|---|---|---|---|
| 284(L) | -1623 -149 -16 | -1338 -500 -7108 | -3726 233 -8150 | -3164 43 -894 | -251 -381 -1115 | -3255 399 -701 | -1820 106 -1378 | 1373 -626 * | -2808 210 * | 2373 -466 | 514 -720 | -2785 275 | -3086 394 | -2281 45 | -2613 96 | -2389 359 | -1543 117 | -161 -369 | -1311 -294 | 1782 -249 | 290 |
| 285(L) | -2333 -149 -16 | -1873 -500 -7108 | -4640 233 -8150 | -4127 43 -894 | -650 -381 -1115 | -4326 399 -701 | -3241 106 -1378 | 2176 -626 * | -3843 210 * | 2519 -466 | 523 -720 | -3982 275 | -3833 394 | -3105 45 | -3579 96 | -3604 359 | -2247 117 | 56 -369 | -2268 -294 | -2230 -249 | 291 |
| 286(A) | 3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 292 |
| 287(M) | -1886 -149 -16 | -1507 -500 -7108 | -4178 233 -8150 | -3693 43 -894 | -877 -381 -1115 | -3806 399 -701 | -2901 106 -1378 | 3008 -626 * | -3380 210 * | 335 -466 | 3109 -720 | -3451 275 | -3570 394 | -2934 45 | -3251 96 | -3044 359 | -1840 117 | 524 -369 | -2288 -294 | -2089 -249 | 293 |
| 288(A) | 3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 294 |
| 289(H) | -1490 -149 -16 | -2484 -500 -7108 | -362 233 -8150 | -476 43 -894 | -1816 -381 -1115 | -1880 399 -701 | 4320 106 -1378 | -2854 -626 * | -684 210 * | -2770 -466 | -2133 -720 | 2185 275 | -2285 394 | -728 45 | -1000 96 | -1377 359 | -1550 117 | -2475 -369 | -2146 -294 | -1255 -249 | 295 |
| 290(A) | 3439 -149 -16 | -911 -500 -7108 | -2326 233 -8150 | -2131 43 -894 | -2811 -381 -1115 | -1197 399 -701 | -1934 106 -1378 | -2480 -626 * | -2011 210 * | -2745 -466 | -1898 -720 | -1490 275 | -1888 394 | -1785 45 | -2153 96 | 1898 359 | 1073 117 | -1682 -369 | -3044 -294 | -2749 -249 | 296 |
| 291(I) | 2038 -149 -16 | -985 -500 -7108 | -3388 233 -8150 | -2919 43 -894 | -1320 -381 -1115 | -2893 399 -701 | -2277 106 -1378 | 2355 -626 * | -2677 210 * | -587 -466 | -297 -720 | -2593 275 | -2992 394 | -2450 45 | -2697 96 | -2087 359 | -1208 117 | 1681 -369 | -2229 -294 | -1846 -249 | 297 |
| 292(G) | -1243 -149 -16 | -2769 -500 -7108 | 311 233 -8150 | 1902 43 -894 | -3172 -381 -1115 | 1980 399 -701 | -744 106 -1378 | -2992 -626 * | -697 210 * | -2936 -466 | -2152 -720 | 1923 275 | -1974 394 | -377 45 | -1331 96 | -1030 359 | -1284 117 | -2506 -369 | -3125 -294 | -2308 -249 | 298 |
| 293(V) | -1738 -149 -16 | -1298 -500 -7108 | -4281 233 -8150 | -3921 43 -894 | -1737 -381 -1115 | -3979 399 -701 | -3665 106 -1378 | 1917 -626 * | -3774 210 * | -601 -466 | -528 -720 | -3671 275 | -3834 394 | -3628 45 | -3843 96 | -3293 359 | -1735 117 | 3205 -369 | -3215 -294 | -2770 -249 | 299 |
| 294(E) | -833 -149 -16 | -2344 -500 -7108 | 1092 233 -8150 | 2412 43 -894 | -2643 -381 -1115 | -1464 399 -701 | -386 106 -1378 | -2413 -626 * | -146 210 * | -2369 -466 | -1505 -720 | 96 275 | 562 394 | 29 45 | -717 96 | -666 359 | 862 117 | -1966 -369 | -2562 -294 | -1818 -249 | 300 |
| 295(W) | -1380 -149 -16 | -1116 -500 -7108 | -3614 233 -8150 | -3026 43 -894 | 1322 -381 -1115 | -2981 399 -701 | -1582 106 -1378 | 1966 -626 * | -2661 210 * | 1775 -466 | 556 -720 | -2562 275 | -2865 394 | -2117 45 | -2424 96 | -2098 359 | -1302 117 | -187 -369 | 2908 -294 | -629 -249 | 301 |

TABLE 6-continued

| | | | | | | | | | | | | | | | | | | |
|---|---|---|---|---|---|---|---|---|---|---|---|---|---|---|---|---|---|---|
| 296(T) | -350 -149 -16 | -973 -500 -7108 | -2204 233 -8150 | -2178 43 -894 | -2893 -381 -1115 | -1236 399 -701 | -2035 106 -1378 | -2561 -626 * | -2117 210 * | -2862 -466 | -2043 -720 | -1536 275 | -1946 394 | -1916 45 | -2214 96 | 1618 359 | 3198 117 | -1758 -369 | -3137 -294 | -2831 -249 | 302 |
| 297(L) | -1443 -149 -16 | -1269 -500 -7108 | -3144 233 -8150 | -2576 43 -894 | -528 -381 -1115 | -3014 399 -701 | -1816 106 -1378 | 1945 -626 * | -2155 210 * | 2102 -466 | 508 -720 | -2422 275 | -2899 394 | 1193 45 | -2133 96 | -2129 359 | -1369 117 | -50 -369 | -1616 -294 | -1384 -249 | 303 |
| 298(D) | -1826 -149 -16 | -3682 -500 -7108 | 3559 233 -8150 | 1199 43 -894 | -3883 -381 -1115 | -1662 399 -701 | -1073 106 -1378 | -3846 -626 * | -1391 210 * | -3720 -466 | -3110 -720 | -272 275 | -2222 394 | -760 45 | -2283 96 | -1471 359 | -1913 117 | -3321 -369 | -3864 -294 | -2864 -249 | 304 |
| 299(D) | -2784 -149 -16 | -3432 -500 -7108 | 4016 233 -8150 | -1200 43 -894 | -4140 -381 -1115 | -2466 399 -701 | -2197 106 -1378 | -4505 -626 * | -2621 210 * | -4365 -466 | -3956 -720 | -1551 275 | -3014 394 | -2039 45 | -3232 96 | -2593 359 | -2938 117 | -4046 -369 | -3710 -294 | -3552 -249 | 305 |
| 300(F) | -3342 -149 -16 | -2776 -500 -7108 | -4026 233 -8150 | -4232 43 -894 | 4354 -381 -1115 | -3545 399 -701 | -1431 106 -1378 | -2315 -626 * | -4038 210 * | -1801 -466 | -1900 -720 | -3299 275 | -3780 394 | -3350 45 | -3645 96 | -3490 359 | -3420 117 | -2566 -369 | -739 -294 | 349 -249 | 306 |
| 301(Q) | -1048 -149 -16 | -2608 -500 -7108 | 205 233 -8150 | 2170 43 -894 | -2893 -381 -1115 | -1535 399 -701 | -505 106 -1378 | -2680 -626 * | -255 210 * | -2604 -466 | -1769 -720 | 1814 275 | -1849 394 | 2272 45 | -789 96 | -848 359 | -1028 117 | -2228 -369 | -2770 -294 | -2013 -249 | 307 |
| 302(R) | 1083 -149 -16 | -1687 -500 -7108 | 691 233 -8150 | 135 43 -894 | -2058 -381 -1115 | -1406 399 -701 | -178 106 -1378 | -1755 -626 * | 214 210 * | -1793 -466 | -924 -720 | -145 275 | -1553 394 | 247 45 | 1670 96 | -383 359 | 1217 117 | -1367 -369 | -2031 -294 | -1404 -249 | 308 |
| 303(I) | -1915 -149 -16 | -1536 -500 -7108 | -4077 233 -8150 | -3667 43 -894 | 2027 -381 -1115 | -3678 399 -701 | -2155 106 -1378 | 3137 -626 * | -3381 210 * | 144 -466 | 94 -720 | -3225 275 | -3506 394 | -2848 45 | -3202 96 | -2914 359 | -1871 117 | 345 -369 | -1522 -294 | -791 -249 | 309 |
| 304(R) | -689 -149 -16 | -2015 -500 -7108 | 494 233 -8150 | 24 43 -894 | -2395 -381 -1115 | -1582 399 -701 | -184 106 -1378 | -2087 -626 * | 444 210 * | -2020 -466 | -1151 -720 | 1161 275 | -1687 394 | 1832 45 | 2131 96 | 626 359 | -614 117 | -1684 -369 | -2156 -294 | -1573 -249 | 310 |
| 305(D) | 387 -149 -16 | -1967 -500 -7108 | 1600 233 -8150 | 1359 43 -894 | -2275 -381 -1115 | -1391 399 -701 | 1561 106 -1378 | -2025 -626 * | 282 210 * | -1976 -466 | -1067 -720 | -25 275 | -1525 394 | 342 45 | 1024 96 | -369 359 | 443 117 | -1584 -369 | -2152 -294 | -1462 -249 | 311 |
| 306(R) | -1460 -149 -16 | -2315 -500 -7108 | -1793 233 -8150 | -887 43 -894 | -2832 -381 -1115 | -2237 399 -701 | -431 106 -1378 | -2288 -626 * | 2193 210 * | -2199 -466 | -1473 -720 | -946 275 | -2245 394 | -20 45 | -2706 96 | -1394 359 | -1275 117 | 591 -369 | -2248 -294 | -1961 -249 | 312 |
| 307(V) | -947 -149 -16 | -1027 -500 -7108 | -3099 233 -8150 | -2832 43 -894 | -1692 -381 -1115 | -2234 399 -701 | -2324 106 -1378 | 470 -626 * | -2565 210 * | -1003 -466 | -695 -720 | -2305 275 | -2663 394 | -2399 45 | -2587 96 | -1527 359 | 1858 117 | 2876 -369 | -2536 -294 | -2152 -249 | 313 |

TABLE 6-continued

| | | | | | | | | | | | | | | | | | | | |
|---|---|---|---|---|---|---|---|---|---|---|---|---|---|---|---|---|---|---|---|
| 308(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 314 |
| 309(V) | -1090 -149 -16 | -1215 -500 -7108 | -2097 233 -8150 | -1824 43 -894 | -819 -381 -1115 | -2221 399 -701 | 2699 106 -1378 | -287 -626 * | -1392 210 * | -1027 -466 | -591 -720 | -1674 275 | -2482 394 | -1446 45 | -1482 96 | -1482 359 | -1143 117 | 2879 -369 | -1420 -294 | -707 -249 | 315 |
| 310(L) | -2439 -149 -16 | -1972 -500 -7108 | -4702 233 -8150 | -4181 43 -894 | -588 -381 -1115 | 4401 399 -701 | -3528 106 -1378 | 1582 -626 * | -3881 210 * | 2757 -466 | 587 -720 | -4061 275 | -3862 394 | -3093 45 | -3590 96 | -3689 359 | -2344 117 | -130 -369 | -2230 -294 | -2217 -249 | 316 |
| 311(C) | 2157 -149 -16 | 4166 -500 -7108 | -3012 233 -8150 | -2973 43 -894 | -2780 -381 -1115 | 1022 399 -701 | -2337 106 -1378 | -2398 -626 * | -2724 210 * | -2744 -466 | -1930 -720 | -1786 275 | -1943 394 | -2372 45 | -2623 96 | -540 359 | -692 117 | -1624 -369 | -3091 -294 | -2881 -249 | 317 |
| 312(D) | -1732 -149 -16 | -3453 -500 -7108 | 3468 233 -8150 | 99 43 -894 | -3733 -381 -1115 | -1645 399 -701 | -1066 106 -1378 | -3747 -626 * | -1356 210 * | -3641 -466 | -3008 -720 | 1690 275 | -2201 394 | -755 45 | -2209 96 | -1416 359 | -1833 117 | -3208 -369 | -3752 -294 | -2776 -249 | 318 |
| 313(L) | -2477 -149 -16 | -2023 -500 -7108 | -4713 233 -8150 | -4122 43 -894 | 1592 -381 -1115 | -4329 399 -701 | -2920 106 -1378 | 72 -626 * | -3835 210 * | 2593 -466 | 2472 -720 | -3948 275 | -3754 394 | -2914 45 | -3466 96 | -3550 359 | -2350 117 | -634 -369 | -1927 -294 | -1830 -249 | 319 |
| 314(K) | -2690 -149 -16 | -2961 -500 -7108 | -2461 233 -8150 | -2046 43 -894 | -3743 -381 -1115 | -2791 399 -701 | -1570 106 -1378 | -3603 -626 * | 3784 210 * | -3387 -466 | -2839 -720 | -2048 275 | -3039 394 | -1260 45 | -465 96 | -2604 359 | -2536 117 | -3331 -369 | -3001 -294 | -2988 -249 | 320 |
| 315(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 321 |
| 316(S) | -897 -149 -16 | -1462 -500 -7108 | -2333 233 -8150 | -2543 43 -894 | -3185 -381 -1115 | -1640 399 -701 | -2474 106 -1378 | -3294 -626 * | -2686 210 * | -3497 -466 | -2780 -720 | -1973 275 | -2360 394 | -2483 45 | -2703 96 | 3465 359 | -1316 117 | -2413 -369 | -3310 -294 | -3025 -249 | 322 |
| 317(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 323 |
| 318(K) | 2 -149 -16 | -2257 -500 -7108 | -1073 233 -8150 | -374 43 -894 | -2740 -381 -1115 | -1908 399 -701 | -278 106 -1378 | -2339 -626 * | 2328 210 * | -2192 -466 | -1373 -720 | -562 275 | -1953 394 | 2273 45 | 1344 96 | -952 359 | -933 117 | -1980 -369 | -2234 -294 | -1799 -249 | 324 |
| 319(Y) | -3482 -149 -16 | -2868 -500 -7108 | -3701 233 -8150 | -3919 43 -894 | 238 -381 -1115 | -3552 399 -701 | -1112 106 -1378 | -3000 -626 * | -3638 210 * | -2516 -466 | -2526 -720 | -3027 275 | -3772 394 | -3101 45 | -3341 96 | -3418 359 | -3527 117 | -3071 -369 | -441 -294 | 4711 -249 | 325 |

TABLE 6-continued

| | | | | | | | | | | | | | | | | | | |
|---|---|---|---|---|---|---|---|---|---|---|---|---|---|---|---|---|---|---|
| 320(M) | -1559 -149 -16 | -1267 -500 -7108 | -3829 233 -8150 | -3380 43 -894 | -1103 -381 -1115 | -3357 399 -701 | -2655 106 -1378 | 805 -626 * | -3067 210 * | -64 -466 | 3046 -720 | 3065 275 | -3326 394 | -2779 45 | -3011 96 | -2591 359 | -1556 117 | 2855 -369 | -2312 -294 | -1998 -249 | 326 |
| 321(M) | 1225 -149 -16 | -469 -500 -7108 | -2256 233 -8150 | -1679 43 -894 | 1656 -381 -1115 | -1926 399 -701 | -870 106 -1378 | 90 -626 * | -1396 210 * | -210 -466 | -2763 -720 | -1424 275 | -2028 394 | -1129 45 | -1411 96 | -1008 359 | 712 117 | 154 -369 | -951 -294 | -586 -249 | 327 |
| 322(T) | -738 -149 -16 | -2094 -500 -7108 | -84 233 -8150 | 1704 43 -894 | -2416 -381 -1115 | -1495 399 -701 | -317 106 -1378 | -2135 -626 * | 61 210 * | -2127 -466 | -1275 -720 | -163 275 | -1704 394 | 1857 45 | 405 96 | -613 359 | 1930 117 | -1734 -369 | -2331 -294 | -1668 -249 | 328 |
| 323(D) | -1746 -149 -16 | -3458 -500 -7108 | 3540 233 -8150 | 90 43 -894 | -3744 -381 -1115 | -1650 399 -701 | -1081 106 -1378 | -3767 -626 * | -1381 210 * | -3662 -466 | -3036 -720 | 1386 275 | -2211 394 | -772 45 | -2239 96 | -1429 359 | -1850 117 | -3226 -369 | -3765 -294 | -2789 -249 | 329 |
| 324(L) | -2451 -149 -16 | -1983 -500 -7108 | -4707 233 -8150 | -4186 43 -894 | -582 -381 -1115 | -4409 399 -701 | -3259 106 -1378 | 1510 -626 * | -3884 210 * | 2778 -466 | 592 -720 | -4069 275 | -3865 394 | -3091 45 | -3590 96 | -3698 359 | -2355 117 | -150 -369 | -2226 -294 | -2214 -249 | 330 |
| 325(H) | -2923 -149 -16 | -2573 -500 -7108 | -2959 233 -8150 | -2926 43 -894 | 826 -381 -1115 | -3449 399 -701 | 4553 106 -1378 | -2508 -626 * | -2463 210 * | -2054 -466 | -1948 -720 | -2279 275 | -3499 394 | -2191 45 | -2397 96 | -2761 359 | -2855 117 | -2540 -369 | 123 -294 | 2920 -249 | 331 |
| 326(K) | 373 -149 -16 | -1957 -500 -7108 | -342 233 -8150 | 1025 43 -894 | -2297 -381 -1115 | -1472 399 -701 | -98 106 -1378 | -2018 -626 * | 2111 210 * | -1954 -466 | -1056 -720 | 906 275 | -1570 394 | 352 45 | 685 96 | -424 359 | 473 117 | -1592 -369 | -2105 -294 | -1469 -249 | 332 |
| 327(V) | 1739 -149 -16 | -1008 -500 -7108 | -3509 233 -8150 | -3043 43 -894 | -1376 -381 -1115 | -3028 399 -701 | -2406 106 -1378 | 1765 -626 * | -2087 210 * | -615 -466 | -334 -720 | -2718 275 | -3093 394 | -2585 45 | -2823 96 | -2226 359 | -1263 117 | 2376 -369 | -2322 -294 | -1931 -249 | 333 |
| 328(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 334 |
| 329(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 335 |
| 330(I) | -1758 -149 -16 | -1302 -500 -7108 | -4331 233 -8150 | -3970 43 -894 | -1756 -381 -1115 | -4054 399 -701 | -3748 106 -1378 | 2976 -626 * | -3840 210 * | -608 -466 | -533 -720 | -3731 275 | -3877 394 | -3693 45 | -3914 96 | -3372 359 | -1750 117 | 2505 -369 | -3265 -294 | -2824 -249 | 336 |
| 331(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | 4087 -369 | -3594 -294 | -4064 -249 | 337 |

TABLE 6-continued

| | | | | | | | | | | | | | | | | |
|---|---|---|---|---|---|---|---|---|---|---|---|---|---|---|---|---|
| 332(Q) | 1795 -149 -16 | -1440 -500 -7108 | -730 233 -8150 | -492 43 -894 | -2453 -381 -1115 | 682 399 -701 | -812 106 -1378 | -2151 -626 * | -508 210 * | -2256 -466 | -1426 -720 | -624 275 | -1796 394 | -3666 45 | -901 96 | -590 359 | -689 117 | -1636 -369 | -2510 -294 | -1971 -249 | 338 |
| 333(V) | -1771 -149 -16 | -1603 -500 -7108 | -3750 233 -8150 | -3689 43 -894 | -2037 -381 -1115 | -3050 399 -701 | -3231 106 -1378 | 403 -626 * | -3479 210 * | -1154 -466 | -1076 -720 | -3246 275 | -3399 394 | -3383 45 | -3437 96 | -2628 359 | -1917 117 | -3536 -369 | -3074 -294 | -2677 -249 | 339 |
| 334(M) | -2355 -149 -16 | -1988 -500 -7108 | -4343 233 -8150 | -3834 43 -894 | -504 -381 -1115 | -4051 399 -701 | -2868 106 -1378 | 105 -626 * | -3385 210 * | 1451 -466 | -4460 -720 | -3680 275 | -3671 394 | -2806 45 | -3171 96 | -3327 359 | -2274 117 | -474 -369 | -2039 -294 | -1925 -249 | 340 |
| 335(K) | -2620 -149 -16 | -2961 -500 -7108 | -2461 233 -8150 | -2046 43 -894 | -3743 -381 -1115 | -2791 399 -701 | -1570 106 -1378 | -3603 -626 * | -3784 210 * | -3387 -466 | -2839 -720 | -2048 275 | -3039 394 | -1260 45 | -465 96 | -2604 359 | -2536 117 | -3331 -369 | -3001 -294 | -2988 -249 | 341 |
| 336(Y) | -1187 -149 -16 | -974 -500 -7108 | -3186 233 -8150 | -2638 43 -894 | -117 -381 -1115 | -2732 399 -701 | -1255 106 -1378 | 1905 -626 * | -2270 210 * | 73 -466 | 1977 -720 | -2217 275 | -2699 394 | -1882 45 | -2144 96 | -1841 359 | -1124 117 | 71 -369 | -907 -294 | -3524 -249 | 342 |
| 337(L) | -2871 -149 -16 | -2457 -500 -7108 | -4231 233 -8150 | -4103 43 -894 | -1033 -381 -1115 | -3803 399 -701 | -3165 106 -1378 | -541 -626 * | -3734 210 * | -3130 -466 | -31 -720 | -3935 275 | -3797 394 | -3286 45 | -3484 96 | -3713 359 | -2869 117 | -1136 -369 | -2394 -294 | -2220 -249 | 343 |
| 338(L) | -2871 -149 -16 | -2457 -500 -7108 | -4231 233 -8150 | -4103 43 -894 | -1033 -381 -1115 | -3803 399 -701 | -3165 106 -1378 | -541 -626 * | -3734 210 * | -3130 -466 | -31 -720 | -3935 275 | -3797 394 | -3286 45 | -3484 96 | -3713 359 | -2869 117 | -1136 -369 | -2394 -294 | -2220 -249 | 344 |
| 339(K) | -864 -149 -16 | -1785 -500 -7108 | -860 233 -8150 | -366 43 -894 | -2128 -381 -1115 | -1763 399 -701 | -407 106 -1378 | -1612 -626 * | -3624 210 * | -1800 -466 | -1045 -720 | 629 275 | -1900 394 | -28 45 | 62 96 | -851 359 | -805 117 | 1127 -369 | -2064 -294 | -1581 -249 | 345 |
| 340(N) | 602 -149 -16 | -1686 -500 -7108 | -275 233 -8150 | 1008 43 -894 | -1926 -381 -1115 | -1415 399 -701 | 1528 106 -1378 | -1618 -626 * | 244 210 * | -1673 -466 | 815 -720 | 1897 275 | -1530 394 | 299 45 | -244 96 | -371 359 | -391 117 | 322 -369 | -1934 -294 | -1306 -249 | 346 |
| 341(G) | -1709 -149 -16 | -2639 -500 -7108 | 1362 233 -8150 | -690 43 -894 | -3785 -381 -1115 | -3257 399 -701 | -1671 106 -1378 | -3805 -626 * | -1946 210 * | -3792 -466 | -3137 -720 | -980 275 | -2480 394 | -1424 45 | -2576 96 | -1630 359 | -1936 117 | -3150 -369 | -3628 -294 | -3155 -249 | 347 |
| 342(F) | -942 -149 -16 | -799 -500 -7108 | -2828 233 -8150 | -2226 43 -894 | -2476 -381 -1115 | -2476 399 -701 | -1269 106 -1378 | 1109 -626 * | 581 210 * | 1793 -466 | 516 -720 | -1952 275 | -2453 394 | -1557 45 | -1815 96 | -1558 359 | -875 117 | 52 -369 | -1138 -294 | -794 -249 | 348 |
| 343(L) | -2451 -149 -16 | -1983 -500 -7108 | -4707 233 -8150 | -4186 43 -894 | -582 -381 -1115 | -4409 399 -701 | -3259 106 -1378 | 1510 -626 * | -3884 210 * | -2778 -466 | 592 -720 | -4069 275 | -3865 394 | -3091 45 | -3590 96 | -3698 359 | -2355 117 | -150 -369 | -2226 -294 | -2214 -249 | 349 |

TABLE 6-continued

| | | | | | | | | | | | | | | | | | | |
|---|---|---|---|---|---|---|---|---|---|---|---|---|---|---|---|---|---|---|
| 344(H) | -3205 -149 -16 | -3079 -500 -7108 | -2723 233 -8150 | -2890 43 -894 | -2110 -381 -1115 | -3046 399 -701 | -3295 106 -1378 | -4135 -626 * | -2617 210 * | -3813 -466 | -3561 -720 | -2886 275 | -3482 394 | -2833 45 | -2620 96 | -3291 359 | -3356 117 | -3895 -369 | -2397 -294 | -1681 -249 | 350 |
| 345(G) | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 351 |
| 346(D) | -2784 -149 -16 | -3432 -500 -7108 | -4016 233 -8150 | -1200 43 -894 | -4140 -381 -1115 | -2466 399 -701 | -2197 106 -1378 | -4505 -626 * | -2621 210 * | -4365 -466 | -3956 -720 | -1551 275 | -3014 394 | -2039 45 | -3232 96 | -2593 359 | -2938 117 | -4046 -369 | -3710 -294 | -3552 -249 | 352 |
| 347(C) | 774 -149 -16 | 4452 -500 -7108 | -2162 233 -8150 | -1688 43 -894 | -1962 -381 -1115 | -1478 399 -701 | -1302 106 -1378 | -1474 -626 * | -944 210 * | -1796 -466 | -1088 -720 | -1351 275 | -1979 394 | -1147 45 | 1684 96 | -732 359 | -719 117 | -1116 -369 | -2225 -294 | -1881 -249 | 353 |
| 348(L) | -2387 -149 -16 | -1922 -500 -7108 | -4674 233 -8150 | -4155 43 -894 | -617 -381 -1115 | -4366 399 -701 | -3250 106 -1378 | 1889 -626 * | -3865 210 * | 2630 -466 | 558 -720 | -4023 275 | -3847 394 | -3098 45 | -3586 96 | -3647 359 | -2296 117 | -38 -369 | -2247 -294 | -2224 -249 | 354 |
| 349(T) | -1213 -149 -16 | -1674 -500 -7108 | -2755 233 -8150 | -2906 43 -894 | -3163 -381 -1115 | -1922 399 -701 | -2659 106 -1378 | -2698 -626 * | -2788 210 * | -3105 -466 | -2612 -720 | -2311 275 | -2600 394 | -2708 45 | -2753 96 | -1463 359 | 3819 117 | -2197 -369 | -3286 -294 | -3156 -249 | 355 |
| 350(C) | -1489 -149 -16 | 2072 -500 -7108 | -4007 233 -8150 | -3563 43 -894 | -1524 -381 -1115 | -3541 399 -701 | -2939 106 -1378 | 2612 -626 * | -3350 210 * | -617 -466 | 413 -720 | -3224 275 | -3470 394 | -3129 45 | -3335 96 | -2770 359 | -1475 117 | 2269 -369 | -2657 -294 | -2248 -249 | 356 |
| 351(T) | -364 -149 -16 | -979 -500 -7108 | -2232 233 -8150 | -2250 43 -894 | -2904 -381 -1115 | -1245 399 -701 | -2090 106 -1378 | -2559 -626 * | -2191 210 * | -2881 -466 | -2075 -720 | -1571 275 | -1964 394 | -1991 45 | -2260 96 | 905 359 | 3428 117 | -1762 -369 | -3159 -294 | -2858 -249 | 357 |
| 352(G) | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 358 |
| 353(K) | -1716 -149 -16 | -2632 -500 -7108 | -2004 233 -8150 | -1008 43 -894 | -3336 -381 -1115 | -2379 399 -701 | -444 106 -1378 | -2764 -626 * | 2778 210 * | -2484 -466 | -1756 -720 | -1035 275 | -2357 394 | 2151 45 | 1811 96 | -1592 359 | -1477 117 | -2481 -369 | -2391 -294 | -2172 -249 | 359 |
| 354(T) | -1213 -149 -16 | -1674 -500 -7108 | -2755 233 -8150 | -2906 43 -894 | -3163 -381 -1115 | -1922 399 -701 | -2659 106 -1378 | -2698 -626 * | -2788 210 * | -3105 -466 | -2612 -720 | -2311 275 | -2600 394 | -2708 45 | -2753 96 | -1463 359 | 3819 117 | -2197 -369 | -3286 -294 | -3156 -249 | 360 |
| 355(V) | -1771 -149 -16 | -1339 -500 -7108 | -4275 233 -8150 | -3816 43 -894 | -1235 -381 -1115 | -3919 399 -701 | -3194 106 -1378 | 2139 -626 * | -3617 210 * | 1520 -466 | -66 -720 | -3558 275 | -3681 394 | -3244 45 | -3547 96 | -3164 359 | -1733 117 | 2390 -369 | -2634 -294 | -2369 -249 | 361 |

TABLE 6-continued

| | | | | | | | | | | | | | | | | | | |
|---|---|---|---|---|---|---|---|---|---|---|---|---|---|---|---|---|---|---|
| 356(A) | 3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 362 |
| 357(E) | -2641 -149 -16 | -3308 -500 -7108 | -896 233 -8150 | 3732 43 -894 | -3966 -381 -1115 | -2458 399 -701 | -2043 106 -1378 | -4105 -626 * | -2128 210 * | -4016 -466 | -3555 -720 | -1531 275 | -2959 394 | -1842 45 | -2560 96 | -2479 359 | -2750 117 | -3722 -369 | -3563 -294 | -3385 -249 | 363 |
| 358(N) | -823 -149 -16 | -1917 -500 -7108 | -96 233 -8150 | 1188 43 -894 | -2187 -381 -1115 | -1547 399 -701 | -506 106 -1378 | -1711 -626 * | -265 210 * | -1955 -466 | -1191 -720 | 2711 275 | -1815 394 | -144 45 | -747 96 | -757 359 | -815 117 | 1140 -369 | -2297 -294 | -1666 -249 | 364 |
| 359(L) | -2153 -149 -16 | -1779 -500 -7108 | -4360 233 -8150 | -3884 43 -894 | -675 -381 -1115 | -3965 399 -701 | -3012 106 -1378 | 392 -626 * | -3561 210 * | 2726 -466 | 467 -720 | -3673 275 | -3662 394 | -2955 45 | -3355 96 | -3239 359 | -2102 117 | 1281 -369 | -2207 -294 | -2099 -249 | 365 |
| 360(E) | 1136 -149 -16 | -2084 -500 -7108 | -175 233 -8150 | 2027 43 -894 | -2436 -381 -1115 | -1510 399 -701 | -274 106 -1378 | -2147 -626 * | 1525 210 * | -2118 -466 | -1254 -720 | -175 275 | -1692 394 | 152 45 | -251 96 | -593 359 | -670 117 | -1736 -369 | -2296 -294 | -1650 -249 | 366 |
| 361(H) | 893 -149 -16 | -1761 -500 -7108 | 1357 233 -8150 | 214 43 -894 | -2092 -381 -1115 | -1387 399 -701 | 1862 106 -1378 | -1810 -626 * | 229 210 * | -1825 -466 | -942 -720 | -83 275 | -1527 394 | 293 45 | -273 96 | 640 359 | 793 117 | -1409 -369 | -2050 -294 | -1397 -249 | 367 |
| 362(I) | 608 -149 -16 | -458 -500 -7108 | -2776 233 -8150 | -2176 43 -894 | 1666 -381 -1115 | -2202 399 -701 | -1113 106 -1378 | 1712 -626 * | -1836 210 * | -222 -466 | 338 -720 | -1782 275 | -2245 394 | -1512 45 | -1731 96 | -1292 359 | 867 117 | 1366 -369 | -1036 -294 | -684 -249 | 368 |
| 363(P) | -922 -149 -16 | -1912 -500 -7108 | 1681 233 -8150 | -141 43 -894 | -2123 -381 -1115 | -1604 399 -701 | -687 106 -1378 | -1787 -626 * | -550 210 * | 187 -466 | -1245 -720 | -427 275 | 2677 394 | -363 45 | -1049 96 | -882 359 | -947 117 | -1524 -369 | -2338 -294 | -1711 -249 | 369 |
| 364(D) | -1692 -149 -16 | -3605 -500 -7108 | 3364 233 -8150 | 1256 43 -894 | -3770 -381 -1115 | -1599 399 -701 | -957 106 -1378 | -3700 -626 * | -1216 210 * | -3569 -466 | -2909 -720 | 1025 275 | -2138 394 | -628 45 | -2083 96 | -1346 359 | -1761 117 | -3174 -369 | -3765 -294 | -2738 -249 | 370 |
| 365(Q) | -877 -149 -16 | -1646 -500 -7108 | -633 233 -8150 | 499 43 -894 | -1610 -381 -1115 | -1781 399 -701 | -505 106 -1378 | -1210 -626 * | -63 210 * | 1648 -466 | -649 -720 | -558 275 | -1931 394 | 3234 45 | -360 96 | -907 359 | -814 117 | -1097 -369 | -1882 -294 | -1385 -249 | 371 |
| 366(P) | -648 -149 -16 | -2019 -500 -7108 | 1139 233 -8150 | 203 43 -894 | -2354 -381 -1115 | -1436 399 -701 | -285 106 -1378 | -2089 -626 * | 29 210 * | -2086 -466 | -1217 -720 | -114 275 | 1965 394 | 1445 45 | -492 96 | -529 359 | 1244 117 | -1672 -369 | -2300 -294 | -1616 -249 | 372 |
| 367(R) | -422 -149 -23 | -1009 -500 -6560 | -1646 233 -7602 | -851 -304 43 -894 | 1406 -381 -1115 | -1496 399 -341 | -183 106 -2249 | -740 -626 * | 147 210 * | -894 -466 | -230 -720 | -440 275 | 775 394 | 21 45 | 2009 96 | -539 359 | -381 117 | -568 -369 | -1136 -294 | -521 -249 | 373 |

TABLE 6-continued

| | | | | | | | | | | | | | | | | | | |
|---|---|---|---|---|---|---|---|---|---|---|---|---|---|---|---|---|---|---|
| 368(D) | 1472 -149 -16 | -1668 -500 -7108 | 1835 233 -8150 | -70 43 -894 | -2356 -381 -1115 | -1385 399 -701 | -511 106 -1378 | -2062 -626 * | -246 210 * | -2128 -466 | -1275 -720 | -318 275 | 1353 394 | -118 45 | -746 96 | -526 359 | 425 117 | -1602 -369 | -2380 -294 | -1752 -249 | 374 |
| 369(G) | -1044 -149 -16 | -2230 -500 -7108 | 2141 233 -8150 | -100 43 -894 | -3222 -381 -1115 | 2291 399 -701 | -982 106 -1378 | -3045 -626 * | -1033 210 * | -3050 -466 | -2258 -720 | -395 275 | -1985 394 | -644 45 | -1669 96 | 858 359 | -1207 117 | -2428 -369 | -3250 -294 | -2493 -249 | 375 |
| 370(Q) | -2562 -149 -16 | -2904 -500 -7108 | -1886 233 -8150 | -1971 43 -894 | -3251 -381 -1115 | -2661 399 -701 | -2079 106 -1378 | -3690 -626 * | -1565 210 * | -3469 -466 | -3081 -720 | -2107 275 | -3091 394 | 4371 45 | -1665 96 | -2585 359 | -2674 117 | -3411 -369 | -3077 -294 | -2821 -249 | 376 |
| 371(D) | -1275 -149 -16 | -2955 -500 -7108 | 2862 233 -8150 | 1330 43 -894 | -3205 -381 -1115 | -1556 399 -701 | -670 106 -1378 | -3029 -626 * | 1509 210 * | -2936 -466 | -2141 -720 | -158 275 | -1955 394 | -290 45 | -1213 96 | -1025 359 | -1281 117 | -2554 -369 | -3111 -294 | -2272 -249 | 377 |
| 372(V) | -1738 -149 -16 | -1298 -500 -7108 | -4281 233 -8150 | -3921 43 -894 | -1737 -381 -1115 | -3979 399 -701 | -3665 106 -1378 | 1917 -626 * | -3774 210 * | -601 -466 | -528 -720 | -3671 275 | -3834 394 | -3628 45 | -3843 96 | -3293 359 | -1735 117 | 3205 -369 | -3215 -294 | -2770 -249 | 378 |
| 373(I) | -2091 -149 -16 | -1746 -500 -7108 | -3971 233 -8150 | -3840 43 -894 | -1676 -381 -1115 | -3532 399 -701 | -3289 106 -1378 | 3684 -626 * | -3581 210 * | -659 -466 | -693 -720 | -3562 275 | -3674 394 | -3445 45 | -3521 96 | -3194 359 | -2146 117 | 449 -369 | -2877 -294 | -2493 -249 | 379 |
| 374(M) | -584 -149 -16 | -1354 -500 -7108 | -847 233 -8150 | -246 43 -894 | -1467 -381 -1115 | -1659 399 -701 | 2505 106 -1378 | -1087 -626 * | 212 210 * | -374 -466 | 2571 -720 | 449 275 | -1729 394 | 1171 45 | 1074 96 | -634 359 | -507 117 | -876 -369 | -1617 -294 | -1128 -249 | 380 |
| 375(P) | -910 -149 -16 | -2031 -500 -7108 | -73 233 -8150 | 1195 43 -894 | -2792 -381 -1115 | -1488 399 -701 | -794 106 -1378 | -2539 -626 * | -629 210 * | -2588 -466 | -1788 -720 | -401 275 | 3005 394 | -439 45 | -1131 96 | 612 359 | -1014 117 | -2050 -369 | -2815 -294 | -2151 -249 | 381 |
| 376(W) | -1588 -149 -16 | -1300 -500 -7108 | -3783 233 -8150 | -3197 43 -894 | -329 -381 -1115 | -3245 399 -701 | -1926 106 -1378 | 2071 -626 * | -2827 210 * | 1901 -466 | 558 -720 | -2822 275 | -3072 394 | -2297 45 | -2616 96 | -2381 359 | -1508 117 | -111 -369 | 3483 -294 | -1042 -249 | 382 |
| 377(E) | -1024 -149 -16 | -2640 -500 -7108 | 1844 233 -8150 | 2310 43 -894 | -2908 -381 -1115 | -1498 399 -701 | -505 106 -1378 | -2711 -626 * | -344 210 * | -2636 -466 | -1791 -720 | -107 275 | -1824 394 | 1521 45 | -957 96 | 207 359 | -1011 117 | -2243 -369 | -2817 -294 | -2021 -249 | 383 |
| 378(N) | -826 -149 -16 | -2349 -500 -7108 | 1089 233 -8150 | 227 43 -894 | -2651 -381 -1115 | -1487 399 -701 | -341 106 -1378 | -2416 -626 * | 1494 210 * | -2346 -466 | -1475 -720 | 2601 275 | -1724 394 | 1005 45 | -522 96 | -657 359 | -787 117 | -1968 -369 | -2511 -294 | -1791 -249 | 384 |
| 379(P) | 1932 -149 -16 | -1116 -500 -7108 | -2232 233 -8150 | -2301 43 -894 | -3058 -381 -1115 | -1358 399 -701 | -2206 106 -1378 | -2706 -626 * | -2336 210 * | -3009 -466 | -2238 -720 | -1674 275 | 3274 394 | -2114 45 | -2406 96 | -739 359 | -914 117 | -1913 -369 | -3260 -294 | -3019 -249 | 385 |

TABLE 6-continued

| | | | | | | | | | | | | | | | | | | | |
|---|---|---|---|---|---|---|---|---|---|---|---|---|---|---|---|---|---|---|---|
| 380(V) | -914 -149 -16 | -773 -500 -7108 | -2713 233 -8150 | -2129 43 -894 | -712 -381 -1115 | -2505 399 -701 | -1388 106 -1378 | 1452 -626 * | 1084 210 * | 1324 -466 | 204 -720 | -1926 275 | -2507 394 | -1580 45 | -1808 96 | -1591 359 | -859 117 | 1591 -369 | -1424 -294 | -1081 -249 | 386 |
| 381(Y) | -1484 -149 -16 | -2331 -500 -7108 | -1762 233 -8150 | -887 43 -894 | -2436 -381 -1115 | -2254 399 -701 | -420 106 -1378 | -2325 -626 * | 2137 210 * | -2195 -466 | -1475 -720 | -949 275 | -2258 394 | -39 45 | 1983 96 | -1411 359 | -1295 117 | -2075 -369 | -2087 -294 | 2868 -249 | 387 |
| 382(E) | 1256 -149 -16 | -1890 -500 -7108 | -206 233 -8150 | 1353 43 -894 | -2196 -381 -1115 | -1401 399 -701 | -89 106 -1378 | -1930 -626 * | 812 210 * | -1898 -466 | -996 -720 | -45 275 | 547 394 | 1252 45 | -162 96 | -356 359 | 414 117 | -1507 -369 | -2083 -294 | -1416 -249 | 388 |
| 383(Q) | -752 -149 -16 | -2272 -500 -7108 | 1586 233 -8150 | 1407 43 -894 | -2561 -381 -1115 | -1448 399 -701 | -308 106 -1378 | -2329 -626 * | -23 210 * | -2276 -466 | -1396 -720 | -71 275 | -1677 394 | 1749 45 | -577 96 | -590 359 | 1569 117 | -1881 -369 | -2459 -294 | -1727 -249 | 389 |
| 384(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 390 |
| 385(H) | -964 -149 -16 | -2089 -500 -7108 | -200 233 -8150 | -136 43 -894 | -2264 -381 -1115 | -1600 399 -701 | 3833 106 -1378 | -2320 -626 * | -296 210 * | -2338 -466 | -1558 -720 | 1362 275 | 1479 394 | -276 45 | -699 96 | -881 359 | -992 117 | -1924 -369 | -2364 -294 | -1652 -249 | 391 |
| 386(L) | -2451 -149 -16 | -1983 -500 -7108 | -4707 233 -8150 | -4186 43 -894 | -582 -381 -1115 | -4409 399 -701 | -3259 106 -1378 | 1510 -626 * | -3884 210 * | 2778 -466 | 592 -720 | -4069 275 | -3865 394 | -3091 45 | -3590 96 | -3698 359 | -2355 117 | -150 -369 | -2226 -294 | -2214 -249 | 392 |
| 387(Q) | 1643 -149 -16 | -1017 -500 -7108 | -1196 233 -8150 | -721 43 -894 | -1189 -381 -1115 | -1714 399 -701 | -668 106 -1378 | 1336 -626 * | -497 210 * | -907 -466 | -297 -720 | -823 275 | -1893 394 | 2044 45 | -794 96 | -784 359 | -569 117 | -339 -369 | -1579 -294 | -1135 -249 | 393 |
| 388(I) | -1760 -149 -16 | -1308 -500 -7108 | -4323 233 -8150 | -3961 43 -894 | -1730 -381 -1115 | -4039 399 -701 | -3721 106 -1378 | 3156 -626 * | -3825 210 * | -575 -466 | -512 -720 | -3720 275 | -3867 394 | -3669 45 | -3893 96 | -3356 359 | -1753 117 | 2241 -369 | -3236 -294 | -2802 -249 | 394 |
| 389(L) | -2871 -149 -16 | -2457 -500 -7108 | -4231 233 -8150 | -4103 43 -894 | -1033 -381 -1115 | -3803 399 -701 | -3165 106 -1378 | -541 -626 * | -3734 210 * | 3130 -466 | -31 -720 | -3935 275 | -3797 394 | -3286 45 | -3484 96 | -3713 359 | -2869 117 | -1136 -369 | -2394 -294 | -2220 -249 | 395 |
| 390(K) | -1259 -149 -16 | -2115 -500 -7108 | -1267 233 -8150 | -676 43 -894 | -970 -381 -1115 | -2105 399 -701 | 1794 106 -1378 | -2040 -626 * | 2549 210 * | -1955 -466 | -1282 -720 | -808 275 | -2165 394 | -167 45 | 114 96 | -1192 359 | -1140 117 | -1801 -369 | -1301 -294 | 2517 -249 | 396 |
| 391(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 397 |

TABLE 6-continued

| | | | | | | | | | | | | | | | | | | |
|---|---|---|---|---|---|---|---|---|---|---|---|---|---|---|---|---|---|---|
| 392(N) | -2171 -149 -16 | -2655 -500 -7108 | -1458 233 -8150 | -1748 43 -894 | -3334 -381 -1115 | -2364 399 -701 | -2267 106 -1378 | -3943 -626 * | -2365 210 * | -3936 -466 | -3437 -720 | 4205 275 | -2932 394 | -2205 45 | -2608 96 | -2224 359 | -2439 117 | -3392 -369 | -3253 -294 | -2909 -249 | 398 |
| 393(L) | -2871 -149 -16 | -2457 -500 -7108 | -4231 233 -8150 | -4103 43 -894 | -1033 -381 -1115 | -3803 399 -701 | -3165 106 -1378 | -541 -626 * | -3734 210 * | 3130 -466 | -31 -720 | -3935 275 | -3797 394 | -3286 45 | -3484 96 | -3713 359 | -2869 117 | -1136 -369 | -2394 -294 | -2220 -249 | 399 |
| 394(A) | 3121 -149 -16 | -934 -500 -7108 | -2489 233 -8150 | -2561 43 -894 | -3081 -381 -1115 | -1203 399 -701 | -2295 106 -1378 | -2766 -626 * | -2533 210 * | -3080 -466 | -2234 -720 | -1669 275 | -1953 394 | -2234 45 | -2533 96 | 936 359 | -746 117 | -1844 -369 | -3331 -294 | -3090 -249 | 400 |
| 395(E) | -522 -149 -16 | -1773 -500 -7108 | -240 233 -8150 | 1676 43 -894 | -2248 -381 -1115 | -1396 399 -701 | -289 106 -1378 | -1968 -626 * | 50 210 * | -1989 -466 | -1115 -720 | -174 275 | 1198 394 | 131 45 | -448 96 | 1226 359 | 677 117 | -1538 -369 | -2214 -294 | -1565 -249 | 401 |
| 396(E) | -1481 -149 -16 | -3230 -500 -7108 | 1425 233 -8150 | 2936 43 -894 | -3481 -381 -1115 | 751 399 -701 | -843 106 -1378 | -3354 -626 * | -954 210 * | -3256 -466 | -2520 -720 | -187 275 | -2057 394 | -492 45 | -1711 96 | -1193 359 | -1527 117 | -2852 -369 | -3445 -294 | -2523 -249 | 402 |
| 397(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 403 |
| 398(A) | 2847 -149 -16 | -932 -500 -7108 | -2454 233 -8150 | -2477 43 -894 | -3066 -381 -1115 | -1198 399 -701 | -2236 106 -1378 | -2763 -626 * | -2439 210 * | -3057 -466 | -2202 -720 | -1635 275 | -1940 394 | -2152 45 | -2471 96 | 1777 359 | -731 117 | -1840 -369 | -3306 -294 | -3056 -249 | 404 |
| 399(V) | -1771 -149 -16 | -1603 -500 -7108 | -3750 233 -8150 | -3689 43 -894 | -2037 -381 -1115 | -3050 399 -701 | -3231 106 -1378 | 403 -626 * | -3479 210 * | -1154 -466 | -1076 -720 | -3246 275 | -3399 394 | -3383 45 | -3437 96 | -2628 359 | -1917 117 | 3536 -369 | -3074 -294 | -2677 -249 | 405 |
| 400(A) | 3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 406 |
| 401(K) | -2620 -149 -16 | -2961 -500 -7108 | -2461 233 -8150 | -2046 43 -894 | -3743 -381 -1115 | -2791 399 -701 | -1570 106 -1378 | -3603 -626 * | 3784 210 * | -3387 -466 | -2839 -720 | -2048 275 | -3039 394 | -1260 45 | -465 96 | -2604 359 | -2536 117 | -3331 -369 | -3001 -294 | -2988 -249 | 407 |
| 402(I) | -1761 -149 -16 | -1312 -500 -7108 | -4317 233 -8150 | -3954 43 -894 | -1713 -381 -1115 | -4027 399 -701 | -3703 106 -1378 | 3225 -626 * | -3814 210 * | -556 -466 | -498 -720 | -3712 275 | -3859 394 | -3653 45 | -3877 96 | -3344 359 | -1754 117 | 2110 -369 | -3216 -294 | -2787 -249 | 408 |
| 403(S) | -348 -149 -16 | -981 -500 -7108 | -2200 233 -8150 | -2194 43 -894 | -2989 -381 -1115 | -1227 399 -701 | -2073 106 -1378 | -2686 -626 * | -2157 210 * | -2970 -466 | -2136 -720 | -1541 275 | -1946 394 | -1946 45 | -2253 96 | 3060 359 | 1398 117 | -1824 -369 | -3217 -294 | -2916 -249 | 409 |

TABLE 6-continued

| | | | | | | | | | | | | | | | | | | | |
|---|---|---|---|---|---|---|---|---|---|---|---|---|---|---|---|---|---|---|---|
| 404(G) | -2594 | -2690 | -3304 | -3623 | -4328 | -3747 | -3462 | -4761 | -3953 | -4671 | -4212 | -3320 | -3352 | -3748 | -3779 | -2839 | -2981 | -4004 | -3668 | -4222 | 410 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 405(V) | -917 | -809 | -2556 | -1976 | -827 | -2491 | -1367 | 1339 | 1455 | 721 | 94 | -1841 | -2501 | -1487 | -1710 | -1570 | -863 | 2038 | -1514 | -1151 | 411 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 406(K) | -1386 | -2643 | -447 | 1824 | -3108 | -1893 | -570 | -2762 | 2860 | -2616 | -1848 | -552 | -2117 | -166 | -3 | -1217 | -1300 | -2388 | -2647 | -2154 | 412 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 407(N) | -537 | -1563 | -449 | -36 | -1889 | 1143 | -307 | -1529 | 932 | -1655 | -844 | 1794 | -1658 | 73 | -356 | -518 | -516 | 924 | -1962 | -1392 | 413 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 408(P) | -894 | -2181 | -369 | 1705 | -2576 | -1650 | -357 | -2268 | 243 | -2210 | -1375 | -330 | 2093 | 63 | 1619 | -774 | -835 | -1876 | -2347 | -1769 | 414 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 409(V) | -419 | -634 | -1376 | -807 | 1053 | -1737 | -499 | -198 | -623 | -505 | 178 | 600 | -1807 | -475 | 475 | 313 | -360 | 1389 | -1016 | 1303 | 415 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 410(I) | -1282 | -1082 | -3022 | -2555 | 2426 | -2683 | 1767 | 2555 | -2191 | -443 | -88 | -2038 | -2692 | -1794 | -2075 | -1793 | -1220 | -317 | -361 | 552 | 416 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 411(T) | -499 | -1595 | -431 | 966 | -1830 | -1487 | -185 | -1449 | 1092 | -1574 | -754 | -207 | -1601 | 213 | -206 | -458 | 2067 | 159 | -1877 | -1296 | 417 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 412(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 418 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 413(P) | -632 | -1230 | -2074 | -2144 | -2996 | -1453 | -2116 | -2631 | -2128 | -2928 | -2213 | -1658 | 3610 | -2006 | -2221 | -852 | 1302 | -1931 | -3185 | -2917 | 419 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 414(A) | -1472 | -1472 | -2846 | -3040 | -3287 | -1726 | -2735 | -2840 | -3028 | -3257 | -2662 | -2236 | -2447 | -2798 | -2944 | -1216 | -1387 | -2183 | -3405 | -3320 | 420 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |
| 415(R) | -1454 | -2316 | -1780 | -878 | -2834 | -2232 | -428 | -2292 | 2281 | -2200 | -1473 | -940 | -2240 | -17 | 2627 | -1386 | -1270 | 588 | -2249 | -1960 | 421 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | | | | | | | | | | | | | |

TABLE 6-continued

| | | | | | | | | | | | | | | | | | |
|---|---|---|---|---|---|---|---|---|---|---|---|---|---|---|---|---|---|
| 416(V) | -1771 -149 -16 | -1603 -500 -7108 | -3750 233 -8150 | -3689 43 -894 | -2037 -381 -1115 | -3050 399 -701 | -3231 106 -1378 | 403 -626 * | -3479 210 * | -1154 -466 | -1076 -720 | -3246 275 | -3399 394 | -3383 45 | -3437 96 | -2628 359 | -1917 117 | -3536 -369 | -3074 -294 | -2677 -249 | 422 |
| 417(F) | -3342 -149 -16 | -2776 -500 -7108 | -4026 233 -8150 | -4332 43 -894 | -4354 -381 -1115 | -3545 399 -701 | -1431 106 -1378 | -2315 -626 * | -4038 210 * | -1801 -466 | -1900 -720 | -3299 275 | -3780 394 | -3350 45 | -3645 96 | -3490 359 | -3420 117 | -2566 -369 | -739 -294 | 349 -249 | 423 |
| 418(D) | -1572 -149 -16 | -3426 -500 -7108 | -2573 233 -8150 | 2447 43 -894 | -3613 -381 -1115 | -1583 399 -701 | -879 106 -1378 | -3513 -626 * | -1050 210 * | -3393 -466 | -2684 -720 | 1292 275 | -2085 394 | -535 45 | -1855 96 | -1253 359 | -1623 117 | -3000 -369 | -3585 -294 | -2609 -249 | 424 |
| 419(S) | -879 -149 -16 | -1989 -500 -7108 | 1498 233 -8150 | -177 43 -894 | -3045 -381 -1115 | 1600 399 -701 | -939 106 -1378 | -2843 -626 * | -904 210 * | -2867 -466 | -2046 -720 | -438 275 | -1922 394 | -591 45 | -1483 96 | -2173 359 | -1044 117 | -2226 -369 | -3072 -294 | -2372 -249 | 425 |
| 420(E) | -2641 -149 -16 | -3308 -500 -7108 | -896 233 -8150 | -3733 43 -894 | -3966 -381 -1115 | -2458 399 -701 | -2043 106 -1378 | -4105 -626 * | -2128 210 * | -4016 -466 | -3555 -720 | -1531 275 | -2959 394 | -1842 45 | -2560 96 | -2479 359 | -2750 117 | -3722 -369 | -3563 -294 | -3385 -249 | 426 |
| 421(Q) | -705 -149 -16 | -1925 -500 -7108 | -199 233 -8150 | 2112 43 -894 | 917 -381 -1115 | -1534 399 -701 | -288 106 -1378 | -1824 -626 * | 42 210 * | -1842 -466 | -1054 -720 | -210 275 | -1709 394 | -2163 45 | -420 96 | -611 359 | -656 117 | -1502 -369 | -1997 -294 | -1291 -249 | 427 |
| 422(H) | -569 -149 -16 | -2048 -500 -7108 | 1450 233 -8150 | 1526 43 -894 | -2349 -381 -1115 | -1405 399 -701 | -1830 106 -1378 | -2103 -626 * | 181 210 * | -2058 -466 | -1157 -720 | -37 275 | -1569 394 | 272 45 | -349 96 | 713 359 | 620 117 | -1662 -369 | -2240 -294 | -1537 -249 | 428 |
| 423(C) | 1626 -149 -16 | 2878 -500 -7108 | -2671 233 -8150 | -2107 43 -894 | 1264 -381 -1115 | -1968 399 -701 | -1091 106 -1378 | 233 -626 * | -1777 210 * | -334 -466 | 250 -720 | -1672 275 | -2128 394 | -1459 45 | -1691 96 | -1096 359 | -529 117 | 1209 -369 | -1066 -294 | -704 -249 | 429 |
| 424(M) | -2042 -149 -16 | -1634 -500 -7108 | -4379 233 -8150 | -3826 43 -894 | -659 -381 -1115 | -3976 399 -701 | -2899 106 -1378 | 2765 -626 * | -3546 210 * | 1204 -466 | 3085 -720 | -3605 275 | -3604 394 | -2896 45 | -3318 96 | -3183 359 | -1961 117 | 195 -369 | -2135 -294 | -2058 -249 | 430 |
| 425(E) | 412 -149 -16 | -2447 -500 -7108 | 1356 233 -8150 | 2370 43 -894 | -2747 -381 -1115 | -1477 399 -701 | -445 106 -1378 | -2527 -626 * | -243 210 * | -2477 -466 | -1622 -720 | -107 275 | 855 394 | -36 45 | -831 96 | -730 359 | -894 117 | -2073 -369 | -2668 -294 | -1906 -249 | 431 |
| 426(A) | -2822 -149 -16 | -1031 -500 -7108 | -2418 233 -8150 | -2539 43 -894 | -3226 -381 -1115 | 1898 399 -701 | -2364 106 -1378 | -2941 -626 * | -2626 210 * | -3229 -466 | -2379 -720 | -1722 275 | -2026 394 | -2302 45 | -2634 96 | -654 359 | -848 117 | -1983 -369 | -3415 -294 | -3226 -249 | 432 |
| 427(I) | -1772 -149 -16 | -1325 -500 -7108 | -4307 233 -8150 | -3877 43 -894 | -1405 -381 -1115 | -3993 399 -701 | -3383 106 -1378 | -2935 -626 * | -3705 210 * | 820 -466 | -217 -720 | -3632 275 | -3761 394 | -3400 45 | -3682 96 | -3260 359 | -1742 117 | 2033 -369 | -2838 -294 | -2525 -249 | 433 |

TABLE 6-continued

| | | | | | | | | | | | | | | | | | | | | |
|---|---|---|---|---|---|---|---|---|---|---|---|---|---|---|---|---|---|---|---|---|
| 428(L) | -875 -149 -16 | -1634 -500 -7108 | -575 233 -8150 | 959 43 -894 | -1581 -381 -1115 | -1769 399 -701 | -525 106 -1378 | -1179 -626 * | -135 210 * | 1884 -466 | -625 -720 | -547 275 | -1931 394 | 1405 45 | -450 96 | -909 359 | -816 117 | -1074 -369 | -1883 -294 | -1383 -249 | 434 |
| 429(A) | 1705 -149 -16 | -1826 -500 -7108 | -180 233 -8150 | 949 43 -894 | -2318 -381 -1115 | -1410 399 -701 | -359 106 -1378 | -2041 -626 * | -53 210 * | -2067 -466 | -1204 -720 | 1001 275 | -1652 394 | 52 45 | -561 96 | 1232 359 | -595 117 | -1609 -369 | -2298 -294 | -1643 -249 | 435 |
| 430(D) | -1074 -149 -16 | -2458 -500 -7108 | 2381 233 -8150 | 60 43 -894 | -2921 -381 -1115 | 1927 399 -701 | -658 106 -1378 | -2710 -626 * | -463 210 * | -2675 -466 | -1860 -720 | -271 275 | -1918 394 | -276 45 | 866 96 | -915 359 | -1100 117 | -2245 -369 | -2845 -294 | -2124 -249 | 436 |
| 431(K) | -688 -149 -16 | -2117 -500 -7108 | 785 233 -8150 | 888 43 -894 | -2469 -381 -1115 | -1529 399 -701 | -187 106 -1378 | -2189 -626 * | 2380 210 * | -2106 -466 | -1221 -720 | -162 275 | -1661 394 | 256 45 | 1134 96 | -553 359 | -619 117 | -1760 -369 | -2240 -294 | -1607 -249 | 437 |
| 432(I) | -2019 -149 -16 | -1582 -500 -7108 | -4380 233 -8150 | -3941 43 -894 | -1000 -381 -1115 | -4086 399 -701 | -3253 106 -1378 | 3295 -626 * | -3671 210 * | 1100 -466 | 145 -720 | -3736 275 | -3783 394 | -3222 45 | -3556 96 | -3378 359 | -1976 117 | 657 -369 | -2517 -294 | -2289 -249 | 438 |
| 433(Q) | -490 -149 -16 | -1797 -500 -7108 | -369 233 -8150 | 171 43 -894 | -2078 -381 -1115 | -1457 399 -701 | 1762 106 -1378 | -1779 -626 * | 1157 210 * | -1780 -466 | -905 -720 | 1165 275 | -1550 394 | 1798 45 | -48 96 | -396 359 | -422 117 | 725 -369 | -1986 -294 | -1366 -249 | 439 |
| 434(A) | 1954 -149 -16 | -1836 -500 -7108 | 1733 233 -8150 | -180 43 -894 | -2714 -381 -1115 | -1429 399 -701 | -806 106 -1378 | -2438 -626 * | -679 210 * | -2518 -466 | -1698 -720 | -430 275 | 1775 394 | -448 45 | -1211 96 | -736 359 | -894 117 | -1923 -369 | -2765 -294 | -2117 -249 | 440 |
| 435(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 441 |
| 436(D) | -1736 -149 -16 | -3455 -500 -7108 | 3490 233 -8150 | 97 43 -894 | -3737 -381 -1115 | -1646 399 -701 | -1070 106 -1378 | -3753 -626 * | -1363 210 * | -3647 -466 | -3016 -720 | 1602 275 | -2204 394 | -760 45 | -2218 96 | -1420 359 | -1838 117 | -3213 -369 | -3756 -294 | -2780 -249 | 442 |
| 437(V) | -1721 -149 -16 | -1302 -500 -7108 | -4229 233 -8150 | -3874 43 -894 | -1705 -381 -1115 | -3894 399 -701 | -3582 106 -1378 | 1607 -626 * | -3706 210 * | -582 -466 | -513 -720 | -3610 275 | -3786 394 | -3559 45 | -3767 96 | -3209 359 | -1725 117 | 3294 -369 | -3158 -294 | -2712 -249 | 443 |
| 438(V) | 594 -149 -16 | -988 -500 -7108 | -3391 233 -8150 | -2911 43 -894 | -1164 -381 -1115 | -2888 399 -701 | -2187 106 -1378 | 845 -626 * | -2637 210 * | 765 -466 | -154 -720 | -2576 275 | -2962 394 | -2387 45 | -2622 96 | -2074 359 | -1205 117 | 2800 -369 | -2084 -294 | -1724 -249 | 444 |
| 439(V) | -1771 -149 -16 | -1603 -500 -7108 | -3750 233 -8150 | -3689 43 -894 | -2037 -381 -1115 | -3050 399 -701 | -3231 106 -1378 | 403 -626 * | -3479 210 * | -1154 -466 | -1076 -720 | -3246 275 | -3399 394 | -3383 45 | -3437 96 | -2628 359 | -1917 117 | 3536 -369 | -3074 -294 | -2677 -249 | 445 |

TABLE 6-continued

| | | | | | | | | | | | | | | | | | | | |
|---|---|---|---|---|---|---|---|---|---|---|---|---|---|---|---|---|---|---|---|
| 440(I) | -1754 -149 -16 | -1308 -500 -7108 | -4295 233 -8150 | -3867 43 -894 | -1434 -381 -1115 | -3978 399 -701 | -3377 106 -1378 | -2661 -626 * | -3697 210 * | 862 -466 | -247 -720 | -3617 275 | -3754 394 | -3406 45 | -3679 96 | -3243 359 | -1725 117 | 2373 -369 | -2852 -294 | -2526 -249 | 446 |
| 441(R) | -2957 -149 -16 | -3022 -500 -7108 | -3318 233 -8150 | -2735 43 -894 | -3796 -381 -1115 | -2998 399 -701 | -1968 106 -1378 | -3912 -626 * | -846 210 * | -3631 -466 | -3157 -720 | -2611 275 | -3280 394 | -1724 45 | -4056 96 | -3026 359 | -2913 117 | -3650 -369 | -3096 -294 | -3185 -249 | 447 |
| 442(Y) | -1321 -149 -16 | -1438 -500 -7108 | -1994 233 -8150 | -1608 43 -894 | 2186 -381 -1115 | 527 399 -701 | -450 106 -1378 | -1117 -626 * | -1481 210 * | -1211 -466 | -693 -720 | 1178 275 | -2522 394 | -1217 45 | -1665 96 | -1518 359 | -1275 117 | -1021 -369 | -198 -294 | -3178 -249 | 448 |
| 443(C) | -675 -149 -16 | -2305 -500 -7108 | -2544 233 -8150 | 972 43 -894 | -572 -381 -1115 | -2236 399 -701 | -1121 106 -1378 | 1373 -626 * | -1671 210 * | 679 -466 | 261 -720 | -1700 275 | -2270 394 | -1403 45 | -1668 96 | -1311 359 | -621 117 | 1601 -369 | -1150 -294 | -790 -249 | 449 |
| 444(G) | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 450 |
| 445(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | -4225 394 | -3781 45 | -3695 96 | -3182 359 | -3279 117 | -4087 -369 | -3594 -294 | -4064 -249 | 451 |
| 446(K) | -1060 -149 -16 | -2058 -500 -7108 | -1088 233 -8150 | -460 43 -894 | -2432 -381 -1115 | -1917 399 -701 | -357 106 -1378 | -1970 -626 * | -2801 210 * | -1978 -466 | -1220 -720 | -632 275 | -1990 394 | 1339 45 | 367 96 | -999 359 | -946 117 | 536 -369 | -2145 -294 | -1717 -249 | 452 |
| 447(G) | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 453 |
| 448(G) | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 454 |
| 449(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | -4225 394 | -3781 45 | -3695 96 | -3182 359 | -3279 117 | -4087 -369 | -3594 -294 | -4064 -249 | 455 |
| 450(G) | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 456 |
| 451(M) | -2406 -149 -16 | -2296 -500 -7108 | -3638 233 -8150 | -3594 43 -894 | -1525 -381 -1115 | -3105 399 -701 | -2824 106 -1378 | -1047 -626 * | -3121 210 * | -596 -466 | -5043 -720 | -3293 275 | -3425 394 | -3046 45 | -2996 96 | -2911 359 | -2552 117 | -1398 -369 | -2513 -294 | -2207 -249 | 457 |

TABLE 6-continued

| | | | | | | | | | | | | | | | | | |
|---|---|---|---|---|---|---|---|---|---|---|---|---|---|---|---|---|---|
| 452(P) | -1659 -149 -16 | -2241 -500 -7108 | -2022 233 -8150 | -1646 43 -894 | -3185 -381 -1115 | -2242 399 -701 | -1373 106 -1378 | -3000 -626 * | -450 210 * | -2936 -466 | -2274 -720 | -1624 275 | 3435 394 | -1065 45 | 2095 96 | -1730 359 | -1750 117 | -2593 -369 | -2816 -294 | -2613 -249 | 458 |
| 453(E) | -2641 -149 -16 | -3308 -500 -7108 | -896 233 -8150 | 3735 43 -894 | -3966 -381 -1115 | -2458 399 -701 | -2043 106 -1378 | -4105 -626 * | -2128 210 * | -4016 -466 | -3555 -720 | -1531 275 | -2959 394 | -1842 45 | -2560 96 | -2479 359 | -2750 117 | -3722 -369 | -3563 -294 | -3385 -249 | 459 |
| 454(M) | -2406 -149 -16 | -2296 -500 -7108 | -3638 233 -8150 | -3594 43 -894 | -1525 -381 -1115 | -3105 399 -701 | -2824 106 -1378 | -1047 -626 * | -3121 210 * | -596 -466 | 5043 -720 | -3293 275 | -3425 394 | -3046 45 | -2996 96 | -2911 359 | -2552 117 | -1398 -369 | -2513 -294 | -2207 -249 | 460 |
| 455(L) | -2871 -149 -16 | -2457 -500 -7108 | -4231 233 -8150 | -4103 43 -894 | -1033 -381 -1115 | -3803 399 -701 | -3165 106 -1378 | -541 -626 * | -3734 210 * | 3130 -466 | -31 -720 | -3935 275 | -3797 394 | -3286 45 | -3484 96 | -3713 359 | -2869 117 | -1136 -369 | -2394 -294 | -2220 -249 | 461 |
| 456(K) | 1368 -149 -16 | -1491 -500 -7108 | -763 233 -8150 | -332 43 -894 | -2319 -381 -1115 | -1417 399 -701 | -551 106 -1378 | -1998 -626 * | 1786 210 * | -2068 -466 | -1221 -720 | -500 275 | -1721 394 | -160 45 | -470 96 | 1631 359 | -587 117 | -1532 -369 | -2299 -294 | -1754 -249 | 462 |
| 457(P) | -1500 -149 -16 | -1738 -500 -7108 | -2514 233 -8150 | -2380 43 -894 | -1555 -381 -1115 | -2358 399 -701 | -2022 106 -1378 | -1126 -626 * | -2063 210 * | 1224 -466 | -841 -720 | -2189 275 | 3436 394 | -2061 45 | -2129 96 | -1822 359 | -1674 117 | -1231 -369 | -2290 -294 | -1878 -249 | 463 |
| 458(T) | -351 -149 -16 | -974 -500 -7108 | -2208 233 -8150 | -2185 43 -894 | -2894 -381 -1115 | -1237 399 -701 | -2041 106 -1378 | -2561 -626 * | -2125 210 * | -2863 -466 | -2046 -720 | -1539 275 | -1948 394 | -1923 45 | -2218 96 | 1543 359 | 3230 117 | -1758 -369 | -3139 -294 | -2834 -249 | 464 |
| 459(S) | -897 -149 -16 | -1462 -500 -7108 | -2333 233 -8150 | -2543 43 -894 | -3185 -381 -1115 | -1640 399 -701 | -2474 106 -1378 | -3294 -626 * | -2686 210 * | -3497 -466 | -2780 -720 | -1973 275 | -2360 394 | -2483 45 | -2703 96 | 3465 359 | -1316 117 | -2413 -369 | -3310 -294 | -3025 -249 | 465 |
| 460(M) | 2706 -149 -16 | -986 -500 -7108 | -2433 233 -8150 | -2144 43 -894 | -1502 -381 -1115 | -1684 399 -701 | -1706 106 -1378 | -700 -626 * | -1858 210 * | -968 -466 | 2744 -720 | -1705 275 | -2188 394 | -1713 45 | -1932 96 | -963 359 | -862 117 | -592 -369 | -2145 -294 | -1794 -249 | 466 |
| 461(I) | -2103 -149 -16 | -1659 -500 -7108 | -4461 233 -8150 | -3992 43 -894 | -869 -381 -1115 | -4152 399 -701 | -3233 106 -1378 | 3082 -626 * | -3723 210 * | 1619 -466 | 290 -720 | -3801 275 | -3788 394 | -3171 45 | -3557 96 | -3432 359 | -2046 117 | 487 -369 | -2418 -294 | -2265 -249 | 467 |
| 462(I) | -1761 -149 -16 | -1312 -500 -7108 | -4317 233 -8150 | -3954 43 -894 | -1713 -381 -1115 | -4027 399 -701 | -3703 106 -1378 | 3225 -626 * | -3814 210 * | -556 -466 | -498 -720 | -3712 275 | -3859 394 | -3653 45 | -3877 96 | -3344 359 | -1754 117 | 2110 -369 | -3216 -294 | -2787 -249 | 468 |
| 463(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 469 |

TABLE 6-continued

| | | | | | | | | | | | | | | | | | | |
|---|---|---|---|---|---|---|---|---|---|---|---|---|---|---|---|---|---|---|
| 464(K) | 1641 -149 -16 | -2033 -500 -7108 | -323 233 -8150 | 914 43 -894 | -2415 -381 -1115 | -1565 399 -701 | -296 106 -1378 | -2097 -626 * | -2052 210 * | -2080 -466 | -1233 -720 | -257 275 | -1736 394 | 125 45 | -133 96 | -646 359 | -702 117 | -1707 -369 | -2258 -294 | -1657 -249 | 470 |
| - | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 471 |
| 465(G) | -1699 -149 -16 | -1807 -500 -7108 | -2268 233 -8150 | -1925 43 -894 | -830 -381 -1115 | -2795 399 -701 | -1551 106 -1378 | -455 -626 * | -1225 210 * | -2510 -466 | 90 -720 | -1958 275 | -2845 394 | 1927 45 | -1308 96 | -2067 359 | -1651 117 | -846 -369 | -1841 -294 | -1454 -249 | 472 |
| 466(L) | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 473 |
| 467(G) | -853 -149 -16 | -2415 -500 -7108 | -3115 233 -8150 | 1717 43 -894 | -2702 -381 -1115 | -1468 399 -701 | -378 106 -1378 | -2484 -626 * | 1085 210 * | -2417 -466 | -1546 -720 | -84 275 | -1732 394 | 41 45 | -699 96 | 696 359 | -824 117 | -2025 -369 | -2594 -294 | -1839 -249 | 474 |
| 468(D) | -892 -149 -16 | -1780 -500 -7108 | -931 233 -8150 | -688 43 -894 | -2757 -381 -1115 | -1643 399 -701 | -830 106 -1378 | -2472 -626 * | 1671 210 * | -2492 -466 | -1708 -720 | -799 275 | -2018 394 | -468 45 | -365 96 | -2676 359 | -1004 117 | -1981 -369 | -2598 -294 | -2130 -249 | 475 |
| 469(S) | -1135 -149 -16 | -3593 -500 -7108 | -3700 233 -8150 | -3406 43 -894 | -1670 -381 -1115 | -2549 399 -701 | -2675 106 -1378 | 653 -626 * | -3101 210 * | -916 -466 | -667 -720 | -2727 275 | -2925 394 | -2870 45 | -3030 96 | -1868 359 | -1288 117 | 2927 -369 | -2619 -294 | -2222 -249 | 476 |
| 470(C) | -2590 -149 -16 | -1035 -500 -7108 | -2404 233 -8150 | -2530 43 -894 | -3236 -381 -1115 | 2290 399 -701 | -2365 106 -1378 | -2954 -626 * | -2627 210 * | -3240 -466 | -2389 -720 | -1719 275 | -2027 394 | -2302 45 | -2637 96 | -656 359 | -851 117 | -1991 -369 | -3423 -294 | -3234 -249 | 477 |
| 471(A) | -2632 -149 -16 | -2152 -500 -7108 | -4630 233 -8150 | -4185 43 -894 | 1767 -381 -1115 | -4324 399 -701 | -2442 106 -1378 | -61 -626 * | -3879 210 * | -2789 -466 | 563 -720 | -3833 275 | -3823 394 | -2970 45 | -3513 96 | -3609 359 | -2518 117 | -738 -369 | -1527 -294 | -945 -249 | 478 |
| 472(L) | -2073 -149 -16 | -1632 -500 -7108 | -4434 233 -8150 | -3975 43 -894 | -911 -381 -1115 | -4130 399 -701 | -3238 106 -1378 | -3164 -626 * | -3706 210 * | 1451 -466 | 244 -720 | -3779 275 | -3785 394 | -3187 45 | -3557 96 | -3413 359 | -2021 117 | 546 -369 | -2449 -294 | -2273 -249 | 479 |
| 473(I) | -1213 -149 -16 | -1674 -500 -7108 | -2755 233 -8150 | -2906 43 -894 | -3163 -381 -1115 | -1922 399 -701 | -2659 106 -1378 | -2698 -626 * | -2788 210 * | -3105 -466 | -2612 -720 | -2311 275 | -2600 394 | -2708 45 | -2753 96 | -1463 359 | -3819 117 | -2197 -369 | -3286 -294 | -3156 -249 | 480 |
| 474(T) | -2784 -149 -16 | -3432 -500 -7108 | -4016 233 -8150 | -1200 43 -894 | -4140 -381 -1115 | -2466 399 -701 | -2197 106 -1378 | -4505 -626 * | -2621 210 * | -4365 -466 | -3956 -720 | -1551 275 | -3014 394 | -2039 45 | -3232 96 | -2593 359 | -2938 117 | 4046 -369 | -3710 -294 | -3552 -249 | 481 |
| 475(D) | | | | | | | | | | | | | | | | | | | | | |

TABLE 6-continued

| | | | | | | | | | | | | | | | | | | | | |
|---|---|---|---|---|---|---|---|---|---|---|---|---|---|---|---|---|---|---|---|---|
| 476(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 482 |
| 477(R) | -2957 -149 -16 | -3022 -500 -7108 | -3318 233 -8150 | -2735 43 -894 | -3796 -381 -1115 | -2998 399 -701 | -1968 106 -1378 | -3912 -626 * | -846 210 * | -3631 -466 | -3157 -720 | -2611 275 | -3280 394 | -1724 45 | 4056 96 | -3026 359 | -2913 117 | -3650 -369 | -3096 -294 | -3185 -249 | 483 |
| 478(F) | -3342 -149 -16 | -2776 -500 -7108 | -4026 233 -8150 | -4232 43 -894 | 4354 -381 -1115 | -3545 399 -701 | -1431 106 -1378 | -2315 -626 * | -4038 210 * | -1801 -466 | -1900 -720 | -3299 275 | -3780 394 | -3350 45 | -3645 96 | -3490 359 | -3420 117 | -2566 -369 | -739 -294 | 349 -249 | 484 |
| 479(S) | -897 -149 -16 | -1462 -500 -7108 | -2333 233 -8150 | -2543 43 -894 | -3185 -381 -1115 | -1640 399 -701 | -2474 106 -1378 | -3294 -626 * | -2686 210 * | -3497 -466 | -2780 -720 | -1973 275 | -2360 394 | -2483 45 | -2703 96 | 3465 359 | -1316 117 | -2413 -369 | -3310 -294 | -3025 -249 | 485 |
| 480(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 486 |
| 481(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 487 |
| 482(T) | -359 -149 -16 | -976 -500 -7108 | -2225 233 -8150 | -2229 43 -894 | -2900 -381 -1115 | -1242 399 -701 | -2074 106 -1378 | -2560 -626 * | -2170 210 * | -2875 -466 | -2064 -720 | -1561 275 | -1958 394 | -1969 45 | -2247 96 | 1110 359 | 3375 117 | -1760 -369 | -3152 -294 | -2850 -249 | 488 |
| 483(Y) | -3402 -149 -16 | -2632 -500 -7108 | -3941 233 -8150 | -4011 43 -894 | 1064 -381 -1115 | -3924 399 -701 | 3388 106 -1378 | -2526 -626 * | -3541 210 * | -1996 -466 | -1973 -720 | -2625 275 | -3821 394 | -2664 45 | -3170 96 | -3135 359 | -3280 117 | -2619 -369 | 3420 -294 | 3756 -249 | 489 |
| 484(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 490 |
| 485(M) | -2322 -149 -16 | -1904 -500 -7108 | -4536 233 -8150 | -3951 43 -894 | 2387 -381 -1115 | 4112 399 -701 | -2676 106 -1378 | 67 -626 * | -3649 210 * | 2034 -466 | 3156 -720 | -3710 275 | -3633 394 | -2803 45 | -3311 96 | -3309 359 | -2204 117 | -588 -369 | -1794 -294 | -1586 -249 | 491 |
| 486(V) | -1771 -149 -16 | -1603 -500 -7108 | -3750 233 -8150 | -3689 43 -894 | -2037 -381 -1115 | -3050 399 -701 | -3231 106 -1378 | 403 -626 * | -3479 210 * | -1154 -466 | -1076 -720 | -3246 275 | -3399 394 | -3383 45 | -3437 96 | -2628 359 | -1917 117 | 3536 -369 | -3074 -294 | -2677 -249 | 492 |
| 487(V) | -1771 -149 -16 | -1603 -500 -7108 | -3750 233 -8150 | -3689 43 -894 | -2037 -381 -1115 | -3050 399 -701 | -3231 106 -1378 | 403 -626 * | -3479 210 * | -1154 -466 | -1076 -720 | -3246 275 | -3399 394 | -3383 45 | -3437 96 | -2628 359 | -1917 117 | 3536 -369 | -3074 -294 | -2677 -249 | 493 |

TABLE 6-continued

| | | | | | | | | | | | | | | | | | | | |
|---|---|---|---|---|---|---|---|---|---|---|---|---|---|---|---|---|---|---|---|
| 488(G) | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 494 |
| 489(H) | -3205 -149 -16 | -3079 -500 -7108 | -2723 233 -8150 | -2890 43 -894 | -2110 -381 -1115 | -3046 399 -701 | -5295 106 -1378 | -4135 -626 * | -2617 210 * | -3813 -466 | -3561 -720 | -2886 275 | -3482 394 | -2833 45 | -2620 96 | -3291 359 | -3356 117 | -3895 -369 | -2397 -294 | -1681 -249 | 495 |
| 490(V) | -1754 -149 -16 | -1297 -500 -7108 | -4329 233 -8150 | -3968 43 -894 | -1770 -381 -1115 | -4053 399 -701 | -3752 106 -1378 | 2604 -626 * | -3840 210 * | -621 -466 | -545 -720 | -3728 275 | -3878 394 | -3699 45 | -3917 96 | -3370 359 | -1746 117 | -3859 -369 | -3276 -294 | -2829 -249 | 496 |
| 491(A) | -2583 -149 -16 | -828 -500 -7108 | -2477 233 -8150 | -2155 43 -894 | -1837 -381 -1115 | -1468 399 -701 | -1728 106 -1378 | -743 -626 * | -1941 210 * | -1564 -466 | -954 -720 | -1607 275 | -2033 394 | -1725 45 | -2034 96 | -738 359 | 1178 117 | 1108 -369 | -2310 -294 | -1972 -249 | 497 |
| 492(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | -4225 394 | -3781 45 | -3695 96 | -3182 359 | -3279 117 | -4087 -369 | -3594 -294 | -4064 -249 | 498 |
| 493(E) | -2641 -149 -16 | -3308 -500 -7108 | -896 233 -8150 | -3732 43 -894 | -3966 -381 -1115 | -2458 399 -701 | -2043 106 -1378 | -4105 -626 * | -2128 210 * | -4016 -466 | -3555 -720 | -1531 275 | -2959 394 | -1842 45 | -2560 96 | -2479 359 | -2750 117 | -3722 -369 | -3563 -294 | -3385 -249 | 499 |
| 494(A) | -3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 500 |
| 495(Y) | -866 -149 -16 | -976 -500 -7108 | -1863 233 -8150 | -1331 43 -894 | 1353 -381 -1115 | -2145 399 -701 | 1318 106 -1378 | -556 -626 * | -1116 210 * | -777 -466 | -173 -720 | -1242 275 | -2197 394 | 1714 45 | -1301 96 | -1173 359 | -802 117 | 888 -369 | 445 -294 | -2749 -249 | 501 |
| 496(D) | 417 -149 -16 | -1831 -500 -7108 | 1647 233 -8150 | 1094 43 -894 | -2065 -381 -1115 | -1488 399 -701 | -353 106 -1378 | -1618 -626 * | -107 210 * | -1820 -466 | -1019 -720 | -189 275 | -1698 394 | 30 45 | -623 96 | -603 359 | -643 117 | 1629 -369 | -2154 -294 | -1520 -249 | 502 |
| 497(G) | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 503 |
| 498(G) | -2594 -149 -16 | -2690 -500 -7108 | -3304 233 -8150 | -3623 43 -894 | -4328 -381 -1115 | -3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 504 |
| 499(T) | 492 -149 -16 | -1190 -500 -7108 | -706 233 -8150 | -181 43 -894 | -1475 -381 -1115 | 311 399 -701 | -333 106 -1378 | -1099 -626 * | -81 210 * | 71 -466 | -509 -720 | 570 275 | 1113 394 | -6 45 | -509 96 | 450 359 | 1123 117 | -835 -369 | -1680 -294 | -1161 -249 | 505 |

TABLE 6-continued

| | | | | | | | | | | | | | | | | | | |
|---|---|---|---|---|---|---|---|---|---|---|---|---|---|---|---|---|---|---|
| 500(I) | -2091 -149 -16 | -1746 -500 -7108 | -3971 233 -8150 | -3840 43 -894 | -1676 -381 -1115 | -3532 399 -701 | -3289 106 -1378 | 3684 -626 * | -3581 210 * | -659 -466 | -693 -720 | -3562 275 | -3674 394 | -3445 45 | -3521 96 | -3194 359 | -2146 117 | 449 -369 | -2877 -294 | -2493 -249 | 506 |
| 501(A) | 3103 -149 -16 | -1036 -500 -7108 | -2445 233 -8150 | -2572 43 -894 | -3222 -381 -1115 | 1051 399 -701 | -2380 106 -1378 | -2930 -626 * | -2650 210 * | -3226 -466 | -2381 -720 | -1739 275 | -2034 394 | -2327 45 | -2648 96 | -664 359 | -857 117 | -1981 -369 | -3412 -294 | -3228 -249 | 507 |
| 502(L) | -2239 -149 -16 | -1892 -500 -7108 | -3711 233 -8150 | -3400 43 -894 | 301 -381 -1115 | -3520 399 -701 | -1210 106 -1378 | -542 -626 * | -2948 210 * | 2564 -466 | -35 -720 | -2786 275 | -3395 394 | -2438 45 | -2750 96 | -2747 359 | -2165 117 | -945 -369 | -573 -294 | 2562 -249 | 508 |
| 503(V) | -1757 -149 -16 | -1387 -500 -7108 | -4101 233 -8150 | -3681 43 -894 | -1174 -381 -1115 | -3714 399 -701 | -3031 106 -1378 | 880 -626 * | -3410 210 * | 1254 -466 | -60 -720 | -3407 275 | -3585 394 | -3094 45 | -3354 96 | -2984 359 | -1743 117 | 3014 -369 | -2536 -294 | -2219 -249 | 509 |
| 504(Q) | -982 -149 -16 | -2251 -500 -7108 | -866 233 -8150 | 971 43 -894 | -2711 -381 -1115 | -1822 399 -701 | -252 106 -1378 | -2340 -626 * | 1444 210 * | -2194 -466 | -1356 -720 | -464 275 | -1885 394 | 2646 45 | 1632 96 | -858 359 | -863 117 | -1958 -369 | -2245 -294 | -1765 -249 | 510 |
| 505(E) | -1162 -149 -16 | -2771 -500 -7108 | 2137 233 -8150 | 2239 43 -894 | -3046 -381 -1115 | -1526 399 -701 | -626 106 -1378 | -2849 -626 * | -546 210 * | -2792 -466 | -1983 -720 | -145 275 | -1905 394 | -242 45 | -1192 96 | -940 359 | 1396 117 | -2385 -369 | -2990 -294 | -2169 -249 | 511 |
| 506(G) | -1707 -149 -16 | -2684 -500 -7108 | 1591 233 -8150 | -614 43 -894 | -3783 -381 -1115 | 3190 399 -701 | -1613 106 -1378 | -3795 -626 * | -1887 210 * | -3775 -466 | -3119 -720 | -915 275 | -2456 394 | -1358 45 | -2539 96 | -1610 359 | -1924 117 | -3150 -369 | -3636 -294 | -3124 -249 | 512 |
| 507(D) | -2784 -149 -16 | -3432 -500 -7108 | 4016 233 -8150 | -1200 43 -894 | -4140 -381 -1115 | -2466 399 -701 | -2197 106 -1378 | -4505 -626 * | -2621 210 * | -4365 -466 | -3956 -720 | -1551 275 | -3014 394 | -2039 45 | -3232 96 | -2593 359 | -2938 117 | -4046 -369 | -3710 -294 | -3552 -249 | 513 |
| 508(M) | -473 -149 -16 | -522 -500 -7108 | -1819 233 -8150 | -1236 43 -894 | -468 -381 -1115 | -1879 399 -701 | -687 106 -1378 | 1519 -626 * | -996 210 * | 566 -466 | 1677 -720 | -1154 275 | -1937 394 | 836 45 | -1131 96 | 1079 359 | 413 117 | 102 -369 | -957 -294 | -585 -249 | 514 |
| 509(I) | -1761 -149 -16 | -1312 -500 -7108 | -4317 233 -8150 | -3954 43 -894 | -1713 -381 -1115 | -4027 399 -701 | -3703 106 -1378 | 3225 -626 * | -3814 210 * | -556 -466 | -498 -720 | -3712 275 | -3859 394 | -3653 45 | -3877 96 | -3344 359 | -1754 117 | 2110 -369 | -3216 -294 | -2787 -249 | 515 |
| 510(T) | 782 -149 -16 | -1467 -500 -7108 | -550 233 -8150 | 1029 43 -894 | -2202 -381 -1115 | -1425 399 -701 | -709 106 -1378 | -1791 -626 * | -472 210 * | -1993 -466 | -1203 -720 | -528 275 | -1787 394 | -368 45 | -902 96 | -617 359 | 2685 117 | -1400 -369 | -2333 -294 | -1783 -249 | 516 |
| 511(I) | -1766 -149 -16 | -1333 -500 -7108 | -4283 233 -8150 | -3923 43 -894 | -1635 -381 -1115 | -3967 399 -701 | -3619 106 -1378 | 3388 -626 * | -3759 210 * | -473 -466 | -437 -720 | -3672 275 | -3822 394 | -3576 45 | -3804 96 | -3285 359 | -1764 117 | 1695 -369 | -3126 -294 | -2717 -249 | 517 |

TABLE 6-continued

| | | | | | | | | | | | | | | | | | | | |
|---|---|---|---|---|---|---|---|---|---|---|---|---|---|---|---|---|---|---|---|
| 512(D) | -2784 -149 -16 | -3432 -500 -7108 | 4016 233 -8150 | -1200 43 -894 | -4140 -381 -1115 | -2466 399 -701 | -2197 106 -1378 | -4505 -626 * | -2621 210 * | -4365 -466 | -3956 -720 | -1551 275 | -3014 394 | -2039 45 | -3232 96 | -2593 359 | -2938 117 | -4046 -369 | -3710 -294 | -3552 -249 | 518 |
| 513(A) | -2705 -149 -16 | -1451 -500 -7108 | -1036 233 -8150 | -913 43 -894 | -2506 -381 -1115 | -1504 399 -701 | -1143 106 -1378 | -2174 -626 * | -794 210 * | -2337 -466 | -1613 -720 | -946 275 | -1993 394 | 2040 45 | -1061 96 | -809 359 | -910 117 | -1703 -369 | -2633 -294 | -2156 -249 | 519 |
| 514(H) | -615 -149 -16 | -1680 -500 -7108 | 1444 233 -8150 | 66 43 -894 | -1883 -381 -1115 | 168 399 -701 | 2680 106 -1378 | -1558 -626 * | -86 210 * | -1691 -466 | -891 -720 | -223 275 | -1680 394 | 31 45 | -577 96 | -571 359 | -585 117 | 1267 -369 | -2007 -294 | -1397 -249 | 520 |
| 515(K) | -654 -149 -16 | -2006 -500 -7108 | -546 233 -8150 | 42 43 -894 | -2376 -381 -1115 | -1581 399 -701 | -133 106 -1378 | -2066 -626 * | 1935 210 * | -1987 -466 | -1107 -720 | 1132 275 | -1658 394 | 1043 45 | 1058 96 | -540 359 | 1180 117 | -1660 -369 | -2113 -294 | -1532 -249 | 521 |
| 516(N) | -933 -149 -16 | -2085 -500 -7108 | -946 233 -8150 | -284 43 -894 | -2472 -381 -1115 | -1822 399 -701 | -253 106 -1378 | -2090 -626 * | 1711 210 * | 76 -466 | -1204 -720 | 1918 275 | -1876 394 | 175 45 | 1799 96 | -841 359 | -817 117 | -1755 -369 | -2132 -294 | -1663 -249 | 522 |
| 517(E) | -416 -149 -16 | -987 -500 -7108 | -843 233 -8150 | 1107 43 -894 | -1070 -381 -1115 | -1583 399 -701 | -338 106 -1378 | -623 -626 * | -183 210 * | 879 -466 | -172 -720 | -489 275 | -1679 394 | -94 45 | -565 96 | 544 359 | 813 117 | 265 -369 | -1379 -294 | -905 -249 | 523 |
| 518(I) | -2258 -149 -16 | -1804 -500 -7108 | -4588 233 -8150 | -4084 43 -894 | -706 -381 -1115 | -4269 399 -701 | -3231 106 -1378 | 2527 -626 * | -3807 210 * | 2292 -466 | 465 -720 | -3923 275 | -3814 394 | -3118 45 | -3570 96 | -3544 359 | -2181 117 | 190 -369 | -2303 -294 | -2237 -249 | 524 |
| 519(Q) | -477 -149 -16 | -1909 -500 -7108 | 958 233 -8150 | 282 43 -894 | -2211 -381 -1115 | -1389 399 -701 | 1484 106 -1378 | -1953 -626 * | 285 210 * | -1921 -466 | -1018 -720 | -32 275 | -1517 394 | 3318 45 | -225 96 | 630 359 | 559 117 | -1525 -369 | -2110 -294 | -1430 -249 | 525 |
| 520(L) | -2127 -149 -16 | -1743 -500 -7108 | -4402 233 -8150 | -3796 43 -894 | 1257 -381 -1115 | -3918 399 -701 | -2674 106 -1378 | 149 -626 * | -3492 210 * | 2527 -466 | 2164 -720 | -3553 275 | -3509 394 | -2714 45 | -3181 96 | -3095 359 | -2019 117 | 570 -369 | -1870 -294 | -1818 -249 | 526 |
| 521(N) | -723 -149 -16 | -2217 -500 -7108 | 958 233 -8150 | 236 43 -894 | -2518 -381 -1115 | -1466 399 -701 | 1611 106 -1378 | -2279 -626 * | 1719 210 * | -2217 -466 | -1334 -720 | 2285 275 | -1666 394 | 166 45 | -401 96 | -570 359 | -677 117 | -1837 -369 | -2382 -294 | -1678 -249 | 527 |
| 522(V) | -1754 -149 -16 | -1297 -500 -7108 | -4330 233 -8150 | -3968 43 -894 | -1770 -381 -1115 | -4053 399 -701 | -3752 106 -1378 | 2623 -626 * | -3841 210 * | -620 -466 | -545 -720 | -3729 275 | -3878 394 | -3699 45 | -3918 96 | -3371 359 | -1746 117 | 3846 -369 | -3277 -294 | -2830 -249 | 528 |
| 523(S) | 1545 -149 -16 | -974 -500 -7108 | -2003 233 -8150 | -1825 43 -894 | -2867 -381 -1115 | -1206 399 -701 | -1790 106 -1378 | -2580 -626 * | -1788 210 * | -2795 -466 | -1932 -720 | -1362 275 | 1826 394 | -1586 45 | -1999 96 | 2362 359 | -672 117 | -1755 -369 | -3057 -294 | -2721 -249 | 529 |

TABLE 6-continued

| | | | | | | | | | | | | | | | | | | |
|---|---|---|---|---|---|---|---|---|---|---|---|---|---|---|---|---|---|---|
| 524(D) | -1776 -149 -16 | -3649 -500 -7108 | -3326 233 -8150 | 1869 43 -894 | -3838 -381 -1115 | -1642 399 -701 | -1031 106 -1378 | -3788 -626 * | -1322 210 * | -3660 -466 | -3029 -720 | -245 275 | -2192 394 | -711 45 | -2201 96 | -1425 359 | -1855 117 | -3264 -369 | -3821 -294 | -2816 -249 | 530 |
| 525(E) | 423 -149 -16 | -2950 -500 -7108 | 1944 233 -8150 | 2696 43 -894 | -3223 -381 -1115 | -1545 399 -701 | -718 106 -1378 | -3047 -626 * | -715 210 * | -2979 -466 | -2196 -720 | -161 275 | -1968 394 | -347 45 | -1403 96 | -1043 359 | -1314 117 | -2569 -369 | -3177 -294 | -2316 -249 | 531 |
| 526(E) | -2641 -149 -16 | -3308 -500 -7108 | -896 233 -8150 | 3733 43 -894 | -3966 -381 -1115 | -2458 399 -701 | -2043 106 -1378 | -4105 -626 * | -2128 210 * | -4016 -466 | -3555 -720 | -1531 275 | -2959 394 | -1842 45 | -2560 96 | -2479 359 | -2750 117 | -3722 -369 | -3563 -294 | -3385 -249 | 532 |
| 527(L) | -2339 -149 -16 | -1899 -500 -7108 | -4618 233 -8150 | 4042 43 -894 | 1570 -381 -1115 | -4204 399 -701 | -2849 106 -1378 | 1440 -626 * | -3758 210 * | -2558 -466 | 676 -720 | -3825 275 | -3700 394 | -2902 45 | -3418 96 | -3418 359 | -2226 117 | -382 -369 | -1924 -294 | -1778 -249 | 533 |
| 528(A) | -2338 -149 -16 | -1990 -500 -7108 | -241 233 -8150 | 938 43 -894 | -2395 -381 -1115 | -1557 399 -701 | -423 106 -1378 | -2061 -626 * | 954 210 * | -2103 -466 | -1286 -720 | -301 275 | -1791 394 | -26 45 | -375 96 | -717 359 | -784 117 | -1691 -369 | -2330 -294 | -1728 -249 | 534 |
| 529(R) | 524 -149 -16 | -2098 -500 -7108 | -789 233 -8150 | -146 43 -894 | -2504 -381 -1115 | -1729 399 -701 | 1632 106 -1378 | -2153 -626 * | 1229 210 * | -2054 -466 | -1204 -720 | -379 275 | -1789 394 | 1328 45 | 2313 96 | -719 359 | -724 117 | -1774 -369 | -2150 -294 | -1637 -249 | 535 |
| 530(R) | -2957 -149 -16 | -3022 -500 -7108 | -3318 233 -8150 | -2735 43 -894 | -3796 -381 -1115 | -2998 399 -701 | -1968 106 -1378 | -3912 -626 * | -846 210 * | -3631 -466 | -3157 -720 | -2611 275 | -3280 394 | -1724 45 | 4056 96 | -3026 359 | -2913 117 | -3650 -369 | -3096 -294 | -3185 -249 | 536 |
| 531(R) | -1895 -149 -16 | -2713 -500 -7108 | -2327 233 -8150 | -1192 43 -894 | -3484 -381 -1115 | -2502 399 -701 | -481 106 -1378 | -2856 -626 * | 2144 210 * | -2544 -466 | -1842 -720 | -1161 275 | -2458 394 | 1393 45 | 3023 96 | -1770 359 | -1619 117 | -2599 -369 | -2421 -294 | -2259 -249 | 537 |
| 532(A) | 2935 -149 -16 | -1714 -500 -7108 | -553 233 -8150 | 857 43 -894 | -2769 -381 -1115 | -1546 399 -701 | -1218 106 -1378 | -2333 -626 * | -1106 210 * | -2591 -466 | -1873 -720 | -809 275 | -2065 394 | -934 45 | -1502 96 | -954 359 | -1103 117 | -1872 -369 | -2898 -294 | -2374 -249 | 538 |
| 533(A) | 1291 -149 -16 | -1874 -500 -7108 | -176 233 -8150 | 1227 43 -894 | -2177 -381 -1115 | -1392 399 -701 | -109 106 -1378 | -1909 -626 * | 277 210 * | -1891 -466 | 995 -720 | 1134 275 | -1522 394 | 1248 45 | -228 96 | -361 359 | 562 117 | -1492 -369 | -2090 -294 | -1419 -249 | 539 |
| 534(W) | -805 -149 -16 | -687 -500 -7108 | -2581 233 -8150 | -2028 43 -894 | 138 -381 -1115 | -2236 399 -701 | -697 106 -1378 | 897 -626 * | -1681 210 * | -421 -466 | 141 -720 | -1645 275 | -2282 394 | -1369 45 | -1627 96 | -1315 359 | 636 117 | -90 -369 | 4479 -294 | 1809 -249 | 540 |
| 535(H) | -408 -149 -16 | -1801 -500 -7108 | -274 233 -8150 | 1284 43 -894 | -2096 -381 -1115 | -1385 399 -701 | 1500 106 -1378 | -1822 -626 * | 1168 210 * | -1802 -466 | -899 -720 | -33 275 | -1479 394 | 1381 45 | -102 96 | -303 359 | 595 117 | 221 -369 | -1996 -294 | -1339 -249 | 541 |

TABLE 6-continued

| | | | | | | | | | | | | | | | | | | |
|---|---|---|---|---|---|---|---|---|---|---|---|---|---|---|---|---|---|---|
| 536(Q) | -650 -149 -16 | -1737 -500 -7108 | -627 233 -8150 | -72 43 -894 | -1981 -381 -1115 | -1615 399 -701 | -209 106 -1378 | -1625 -626 * | 1223 210 * | 392 -466 | -866 -720 | -318 275 | 1222 394 | 3120 45 | 50 96 | -598 359 | -572 117 | -1326 -369 | -1932 -294 | -1394 -249 | 542 |
| 537(P) | -2931 -149 -324 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 543 |
| 538(A) | 2195 -149 -19 | -924 -500 -6804 | -2368 233 -7846 | -546 43 -894 | -1397 -381 -1115 | -1356 399 -701 | -583 106 -1961 | -812 -626 * | -365 210 * | -1167 -466 | -487 -720 | -618 275 | -1660 394 | 1324 45 | -684 96 | -483 359 | -404 117 | 462 -369 | -1703 -294 | -1242 -249 | 544 |
| 539(P) | 411 -149 -16 | -1017 -500 -7108 | -1886 233 -8150 | -1616 43 -894 | -1600 -381 -1115 | -1588 399 -701 | -1411 106 -1378 | -962 -626 * | -1408 210 * | 495 -466 | -755 -720 | -1384 275 | 3136 394 | -1323 45 | -1577 96 | -847 359 | -785 117 | -783 -369 | -2111 -294 | -1716 -249 | 545 |
| 540(R) | -1612 -149 -16 | -2397 -500 -7108 | -2037 233 -8150 | -1033 43 -894 | -2897 -381 -1115 | -2352 399 -701 | -458 106 -1378 | -2365 -626 * | 2184 210 * | 665 -466 | -1520 -720 | -1051 275 | -2334 394 | -1383 45 | 2602 96 | -1545 359 | -1395 117 | -2143 -369 | -2262 -294 | -2014 -249 | 546 |
| 541(Y) | 712 -149 -16 | -796 -500 -7108 | -2334 233 -8150 | -1883 43 -894 | -370 -381 -1115 | -2028 399 -701 | -986 106 -1378 | -143 -626 * | -1607 210 * | -663 -466 | -131 -720 | -1587 275 | -2243 394 | -51 45 | -1656 96 | -1178 359 | -771 117 | 1114 -369 | -965 -294 | 3479 -249 | 547 |
| 542(T) | -527 -149 -16 | -1669 -500 -7108 | 1091 233 -8150 | -27 43 -894 | -2315 -381 -1115 | -1379 399 -701 | -443 106 -1378 | -2033 -626 * | -151 210 * | -2081 -466 | -1218 -720 | -282 275 | 557 394 | -41 45 | -650 96 | 1128 359 | 2077 117 | -1576 -369 | -2321 -294 | -1690 -249 | 548 |
| 543(R) | -2957 -149 -16 | -3022 -500 -7108 | -3318 233 -8150 | -2735 43 -894 | -3796 -381 -1115 | -2998 399 -701 | -1968 106 -1378 | -3912 -626 * | -846 210 * | -3631 -466 | -3157 -720 | -2611 275 | -3280 394 | -1724 45 | 4056 96 | -3026 359 | -2913 117 | -3650 -369 | -3096 -294 | -3185 -249 | 549 |
| 544(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 550 |
| 545(V) | -1747 -149 -16 | -1296 -500 -7108 | -4310 233 -8150 | -3948 43 -894 | -1758 -381 -1115 | -4023 399 -701 | -3716 106 -1378 | 2215 -626 * | -3813 210 * | -615 -466 | -540 -720 | -3705 275 | -3860 394 | -3670 45 | -3887 96 | -3339 359 | -1741 117 | 3087 -369 | -3252 -294 | -2806 -249 | 551 |
| 546(L) | -2871 -149 -16 | -2457 -500 -7108 | -4231 233 -8150 | -4103 43 -894 | -1033 -381 -1115 | -3803 399 -701 | -3165 106 -1378 | -541 -626 * | -3734 210 * | 3130 -466 | -31 -720 | -3935 275 | -3797 394 | -3286 45 | -3484 96 | -3713 359 | -2869 117 | -1136 -369 | -2394 -294 | -2220 -249 | 552 |
| 547(A) | 2404 -149 -16 | -890 -500 -7108 | -1926 233 -8150 | -1629 43 -894 | -1803 -381 -1115 | 1275 399 -701 | -1415 106 -1378 | -1282 -626 * | -1490 210 * | 392 -466 | -963 -720 | -1316 275 | -1930 394 | -1328 45 | -1674 96 | -654 359 | -644 117 | -952 -369 | -2187 -294 | -1810 -249 | 553 |

TABLE 6-continued

| | | | | | | | | | | | | | | | | | | |
|---|---|---|---|---|---|---|---|---|---|---|---|---|---|---|---|---|---|---|
| 548(K) | -2620 -149 -16 | -2961 -500 -7108 | -2461 233 -8150 | -2046 43 -894 | -3743 -381 -1115 | -2791 399 -701 | -1570 106 -1378 | -3603 -626 * | -3784 210 * | -3387 -466 | -2839 -720 | -2048 275 | -3039 394 | -1260 45 | -465 96 | -2604 359 | -2536 117 | -3331 -369 | -3001 -294 | -2988 -249 | 554 |
| 549(Y) | -3621 -149 -16 | -2707 -500 -7108 | -4176 233 -8150 | -4424 43 -894 | 2950 -381 -1115 | -4049 399 -701 | -394 106 -1378 | -2539 -626 * | -4002 210 * | -1942 -466 | -1987 -720 | -2749 275 | -3933 394 | -2854 45 | -3451 96 | -3299 359 | -3499 117 | -2690 -369 | 349 -294 | 4094 -249 | 555 |
| 550(A) | 3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 556 |
| 551(H) | -1741 -149 -16 | -2627 -500 -7108 | -2070 233 -8150 | -1046 43 -894 | -3303 -381 -1115 | -2401 399 -701 | -1378 -1378 | -2751 -626 * | 2478 210 * | -2476 -466 | -1755 -720 | -1061 275 | -2375 394 | -27 45 | 2379 96 | -1621 359 | -1497 117 | -2477 -369 | -2379 -294 | -2161 -249 | 557 |
| 552(L) | -1014 -149 -16 | -876 -500 -7108 | -2956 233 -8150 | -2408 43 -894 | -582 -381 -1115 | -2550 399 -701 | -1529 106 -1378 | 1721 -626 * | -2079 210 * | 2043 -466 | 345 -720 | -2114 275 | -2581 394 | -1775 45 | -2028 96 | 454 359 | -980 117 | 286 -369 | -1414 -294 | -1096 -249 | 558 |
| 553(V) | 933 -149 -16 | -842 -500 -7108 | -2818 233 -8150 | -2467 43 -894 | -1542 -381 -1115 | -1870 399 -701 | -1890 106 -1378 | 154 -626 * | -2226 210 * | -1095 -466 | -617 -720 | -1932 275 | -2326 394 | -1995 45 | -2259 96 | -1126 359 | 1070 117 | 3769 -369 | -2180 -294 | -1826 -249 | 559 |
| 554(S) | -787 -149 -16 | -1522 -500 -7108 | -1486 233 -8150 | -1172 43 -894 | -2714 -381 -1115 | -1599 399 -701 | -1112 106 -1378 | -2500 -626 * | -433 210 * | -2563 -466 | -1791 -720 | -1110 275 | -2067 394 | -796 45 | 1351 96 | 2916 359 | -989 117 | -1943 -369 | -2648 -294 | -2234 -249 | 560 |
| 555(S) | -326 -149 -16 | -1010 -500 -7108 | -1779 233 -8150 | -1541 43 -894 | -2691 -381 -1115 | -1234 399 -701 | -1566 106 -1378 | -2386 -626 * | -1486 210 * | -2594 -466 | -1749 -720 | -1228 275 | 1196 394 | -1330 45 | -1747 96 | 2396 359 | 1967 117 | -1662 -369 | -2876 -294 | -2496 -249 | 561 |
| 556(A) | 3121 -149 -16 | -934 -500 -7108 | -2489 233 -8150 | -2561 43 -894 | -3081 -381 -1115 | -1203 399 -701 | -2295 106 -1378 | -2766 -626 * | -2533 210 * | -3080 -466 | -2234 -720 | -1669 275 | -1953 394 | -2234 45 | -2533 96 | 936 359 | -746 117 | -1844 -369 | -3331 -294 | -3090 -249 | 562 |
| 557(S) | -897 -149 -16 | -1462 -500 -7108 | -2333 233 -8150 | -2543 43 -894 | -3185 -381 -1115 | -1640 399 -701 | -2474 106 -1378 | -3294 -626 * | -2686 210 * | -3497 -466 | -2780 -720 | -1973 275 | -2360 394 | -2483 45 | -2703 96 | 3465 359 | -1316 117 | -2413 -369 | -3310 -294 | -3025 -249 | 563 |
| 558(R) | -586 -149 -16 | -1873 -500 -7108 | -516 233 -8150 | 979 43 -894 | -2188 -381 -1115 | -1543 399 -701 | -123 106 -1378 | -1869 -626 * | 1290 210 * | -353 -466 | -980 -720 | -202 275 | -1622 394 | 314 45 | 1886 96 | 491 359 | 782 117 | -1495 -369 | -2024 -294 | -1439 -249 | 564 |
| 559(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 565 |

TABLE 6-continued

| | | | | | | | | | | | | | | | | | | | |
|---|---|---|---|---|---|---|---|---|---|---|---|---|---|---|---|---|---|---|---|
| 560(C) | 2804 | 3772 | -3185 | -3198 | -2739 | -1303 | -2462 | -2065 | -2882 | -2628 | -1924 | -1927 | -2044 | -2547 | -2727 | -661 | -799 | -1463 | -3099 | -2886 | 566 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 561(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -2677 | 567 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 562(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 568 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 563(D) | -2784 | -3432 | 4016 | -1200 | -4140 | -2466 | -2197 | -4505 | -2621 | -4365 | -3956 | -1551 | -3014 | -2039 | -3232 | -2593 | -2938 | 4046 | -3710 | -3552 | 569 |
| - | -149 | -500 | 233 | 43 | -381 | 399 | 106 | -626 | 210 | -466 | -720 | 275 | 394 | 45 | 96 | 359 | 117 | -369 | -294 | -249 | |
| - | -16 | -7108 | -8150 | -894 | -1115 | -701 | -1378 | * | * | | | | | | | | | | | | |
| 564(V) | -525 | -445 | -2202 | -1627 | 1946 | -2001 | -744 | 1247 | -1346 | -952 | 561 | 1079 | -2030 | -1067 | -1362 | -1067 | 465 | 338 | -714 | -230 | 570 |
| - | * | * | * | * | * | * | * | * | 0 | * | * | * | * | * | * | * | * | * | * | * | |

SEQUENCE LISTING (606 sequences)

SEQ ID NO: 1 - DNA, 1743 bp, Mycobacterium sp.
atgccctcaggaagttcaggaactcccgctgatgctcttcgcgcgagcgactcatcgccggacatcaagccccgcagccgcgacgtcaccgacggcctcgagaagaccgccgcccgcgggatgctgcgggcggtcggcatgggcgacgacgactgggtcaaaccgcagatcggcgtgggttcgtcgtggaacgagatcaccccgtgcaacatgtcgctgcaacggctggcgcagtcggtgaagggcggcgtgcactccgccggcggatttccgctggagttcggcacgatctcggtgtccgacggcatctcgatgggccacgagggcatgcacttctcgctggtctcgcgtgaggtgatcgccgacagcgtcgagaccgtcgtgcaggccgagcgtctcgacggcacggtgctgctggccggctgcgacaagtcgattcccggcatgctgatggccgccgcccggctcgacctggcctcggtcttcctgtacaacggttcgatcatgccgggcgtcgcgaagctcaccgacggctccgagcgggaagtcacgatcatcgacgccttcgaggcggtcggggcgtgcgcccgcgggctgatgtcccgcgaggacgtcgacatcatcgaacgggcgatctgtccgggtgagggcgcctgcggcggtatgtacaccgccaacaccatggcgtcggcggcggaagcgctcggcatgtcgttgccgggcagcgcatctcctgtggccatcgacaagcggcgcgacgagtacgcgcggaagtcgggtgaggcggtcgtcgagatgctgcgccgcggtatcaccgcccgcgacatcctcaccaaggaggccttcgagaacgcgatcgccgtcgtcatggcgttcggcggctccaccaacgccgtgctgcacctgctggccatcgcgtgggaggccaacgtgaagctcaccctcgaggacttcacccgcgtcgggcagaaggtgccgcacctcgccgacgtcaaaccgttcggccgtcacgtcatgaagcacgtcgacgagatcggcggtgtgcccgtggtgatgaaggcgctgctggacgccggactgctgcacggggactgcctcaccatcaccggcgagaccatggccgagaacctggcccacatcgaaccgccggacccggacggcaaggtgctgcgggcgatgaacaacccgatccacccgaccggcggcatcacgatcctgcacggatcgttggcgcccgagggcgcggtcgtgaagtcggcgggcttcgactccgacgtgttcgagggcaccgcaagggttttcgagcgggagcgggcagccctggacgcactcgaggacggcacgatcacccacggcgacgtcgtcgtcatccgctacgagggacccaagggcgggcccgggatgcgcgagatgctcgccatcaccggtgcgatcaagggtgccggcctgggcaaggacgtgctgctgatgaccgacggccggttctccggcggcaccaccggcctgtgcgtcgggcatatcgcccccgaggcggtcgacggcgggcccatcgcgttcgtgcgcgacggcgaccggatccggctcgacgtcgccaagggcacgctggacctcctggtcgacgaggccgaattcgagtcccgcaaagcgggattcgagccgttgcccccggtgtacaccaccggcgtgctggccaagtacacgaagttggtcgggtcggcggcggtcggcgcggtctgcggctag

SEQ ID NO: 2 - protein, 580 aa, Mycobacterium sp.
MPSGSSGTPADALRASDSSPDIKPRSRDVTDGLEKTAARGMLRAVGMGDDDWVKPQIGVGSSWNEITPCNMSLQRLAQSVKGGVHSAGGFPLEFGTISVSDGISMGHEGMHFSLVSREVIADSVETVVQAERLDGTVLLAGCDKSIPGMLMAAARLDLASVFLYNGSIMPGVAKLTDGSEREVTIIDAFEAVGACARGLMSREDVDIIERAICPGEGACGGMYTANTMASAAEALGMSLPGSASPVAIDKRRDEYARKSGEAVVEMLRRGITARDILTKEAFENAIAVVMAFGGSTNAVLHLLAIAWEANVKLTLEDFTRVGQKVPHLADVKPFGRHVMKHVDEIGGVPVVMKALLDAGLLHGDCLTITGETMAENLAHIEPPDPDGKVLRAMNNPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVAKGTLDLLVDEAEFESRKAGFEPLPPVYTTGVLAKYTKLVGSAAVGAVCG

SEQ ID NO: 3 - DNA, 1770 bp, Mycobacterium gilvum
atgtggccgatgaatcgacgggcgcataatcaccccatgccctcagactcacgctcgcattctcttcgcgcaagcggctcatcggtcgacatcaaaccccgcagccgcgacgtgaccgacgggctcgagcgcaccgccgcgcgcggcatgctgcgcgcggtcggcatgaccgacgacgactgggtcaagccccagatcggggtcggctcgtcgtggaacgagatcacgccgtgcaacatgtcgctgcagcggctggcccaggcggtcaagggcggtgtgcacgaggccgggggttacccgctggagttcggcacgatctccgtctccgacggcatctcgatgggccacgagggcatgcacttctcgctggtgtcccgcgaggtcatcgccgacagcgtcgagaccgtggtgcaggccgaacgcctcgacggcacggtgttgctggccggctgcgacaagtcgatccccggcatgctgatggccgcggcccgcctcgatctggcgagcgtgttcttctacaacggctcgatcatgccgggcgtcgcgaagctcaccgacggaagcgagaaggaagtcacgatcatcgacgccttcgaggcggtcggtgcgtgtgcgcgcgggctgatgtcgcgggaggacgtcgacatcatcgagcgggccatctgccccggtgagggcgcctgcggtggcatgtacaccgccaacacgatggcctcggccgccgaggcgctcggcatgtcgctgccgggcagcgcgtctccggtggcgatcgacaagcggcgcgacgactttgcgcgccgctccggcgaggcggtggtcgagatgctgcgtcgcggcatcaccgcccgcgacatcctgaccaaggaggccttcgagaacgcgatcgccgtcgtgatggccttcggcggttccaccaacgcggtgctgcatctgctggccatcgcgtgggaggcgcaggtcgagctgacgctggcggacttcacccggatcgggcagaaggtgccgcacctggcggatgtgaagccgttcggcgcgtacgtgatgaagcacgtcgacgagatcggcggcgtgccggtggtgatgcgggcactgctcgacgccggactgctgcacggggactgcctcacggtgaccggtcagacgatggccgagaacctggcccacatcgagccgccggaccccgacggcaaggtgctgcgggcgatgaacaacccgatccacccgaccggcggcatcacgatcctgcacggatcgctggcccccgagggcgcggtggtcaagtcggccggcttcgactccgacgtgttcgagggcaccgcacgggttttcgagcgcgaacgggcggcgctcgacgcgctggaggacggcacgatcacccacggcgacgtcgtcgtcatccgttacgagggccccaagggcggcccggggatgcgcgagatgctggcgatcaccggtgcgatcaagggcgccgggctgggcaaggacgtgctgctgatgaccgacggacggttctcgggcgggacgacgggtctgtgcgtcgggcacatcgcgccggaggccgtcgacggcggaccgatcgcattcgtgcgtgacggggacaggatccggttggacgtcgccaacggcacgctggacatcctcgtcgacgaggccgagttcgaatcgcgcaaggcgggcttcgaaccgctgccgccggtctacacgacgggggtgctcgccaagtacacgaagctggtgggttcggcggcggtcggcgcggtctgcagttag

SEQ ID NO: 4 - protein, 589 aa, Mycobacterium gilvum
MWPMNRRAHNHPMPSDSRSHSLRASGSSVDIKPRSRDVTDGLERTAARGMLRAVGMTDDDWVKPQIGVGSSWNEITPCNMSLQRLAQAVKGGVHEAGGYPLEFGTISVSDGISMGHEGMHFSLVSREVIADSVETVVQAERLDGTVLLAGCDKSIPGMLMAAARLDLASVFFYNGSIMPGVAKLTDGSEKEVTIIDAFEAVGACARGLMSREDVDIIERAICPGEGACGGMYTANTMASAAEALGMSLPGSASPVAIDKRRDDFARRSGEAVVEMLRRGITARDILTKEAFENAIAVVMAFGGSTNAVLHLLAIAWEAQVELTLADFTRIGQKVPHLADVKPFGAYVMKHVDEIGGVPVVMRALLDAGLLHGDCLTVTGQTMAENLAHIEPPDPDGKVLRAMNNPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVANGTLDILVDEAEFESRKAGFEPLPPVYTTGVLAKYTKLVGSAAVGAVCS

SEQ ID NO: 5 - DNA, 1716 bp, Mycobacterium smegmatis
atgccctcagacgacaagtccactgagactcctgacatcaagccccgcagtcgcgacgtcaccgacggcctcgagaaggcggccgcccgtgggatgctccgtgcggtaggcatgggcgacgccgactgggccaagccgcagatcggcgtcgggtcgtcgtggaacgagatcacgccgtgcaacatgtcgctgcagcgcctcgcgaagtcggtcaaggacggcgtccacgaggcgggcggctacccgctcgaattcggcaccatctcggtgtccgacggcatctcgatgggccacgagggcatgcacttctcgctggtctcgcgcgaggtgatcgccgacagcgtcgagaccgtcgtgcaggccgagcgcctcgacggcacggtcctgctggccggctgcgacaagtccattccgggcatgctcatggctgccgcgcggctggacctcgcctcggtgttcttctacaacggctcgatcatgccgggtgtcgcgaagctgaccgacggcaccgagaaggaagtcacgatcatcgacgcgttcgaggccgtcggcgcgtgcgtgcgcggcctgatgtcgcgtgaggacgtcgacatcatcgagcgcgcgatctgccccggcgagggtgcctgcggcggcatgtacaccgccaacaccatggccagcgccgccgaggccctcggcctgtcgctgcccggcagcgcgtcgccggtcgccatcgacaagcgccgcgacgagttcgcgcgccgctccggcgaggccgtcgtcgacatgctgcgtcgcggcatcaccgctcgcgacatcctcaccaaggaggccttcgagaacgccatcgccgtggtcatggcgttcggcgggtccaccaacgccgtgctgcacctgctggcgatcgcccgcgaggccgaggtggagctgacgctcgacgatttcacgcgcgtcggcagcaaggtcccgcacctcgcggacgtcaagccgttcggccgccatgtcatgaagcacgtcgacgagatcggcggtgtgcccgtggtgatgcgcgctctgctggatgccggtctgctgaacggcgagtgcctgacggtcacgggcaagaccatggccgagaacctggcccacatcgctcccccggatcccgacggcaaggtgctgcgggccatgaacaacccgatccacccgaccggcggcatcacgatcctgcacggctcgctcgctcccgagggtgcggtggtcaagtcagccggcttcgattcggacgtgttcgagggcactgcaagggttttcgaccgcgaacgtgccgcgatggacgcgctcgaggacggcaccatccaggcgggcgacgtcgtggtgatccgctacgagggccccaagggcggtcccggtatgcgcgagatgctcgcgatcaccggcgccatcaagggtgcgggtctgggcaaggacgtgctgctgatgaccgacggtcggttctcgggcggtacgacgggtctgtgcgtcgggcacatcgcgccggaggccgtcgacggcggcccgatcgcgttcgtgcgcgacggtgaccgcatccgcctcgacgtcgccaagggcacgctcgacgtgctcgtcgacgaagaagagttcgaggcccgcaaggccggcttcgaacccctgccgccgcggtacaagaccggtgtgctggccaagtacaccaagctggtccagtccgccgccgtcggcgcagtctgcacctaa

SEQ ID NO: 6 - protein, 571 aa, Mycobacterium smegmatis
MPSDDKSTETPDIKPRSRDVTDGLEKAAARGMLRAVGMGDADWAKPQIGVGSSWNEITPCNMSLQRLAKSVKDGVHEAGGYPLEFGTISVSDGISMGHEGMHFSLVSREVIADSVETVVQAERLDGTVLLAGCDKSIPGMLMAAARLDLASVFFYNGSIMPGVAKLTDGTEKEVTIIDAFEAVGACVRGLMSREDVDIIERAICPGEGACGGMYTANTMASAAEALGLSLPGSASPVAIDKRRDEFARRSGEAVVDMLRRGITARDILTKEAFENAIAVVMAFGGSTNAVLHLLAIAREAEVELTLDDFTRVGSKVPHLADVKPFGRHVMKHVDEIGGVPVVMRALLDAGLLNGECLTVTGKTMAENLAHIAPPDPDGKVLRAMNNPIHPTGGITILHGSLAPEGAVVKSAGFDSDVFEGTARVFDRERAAMDALEDGTIQAGDVVVIRYEGPKGGPGMREMLAITGAIKGAGLGKDVLLMTDGRFSGGTTGLCVGHIAPEAVDGGPIAFVRDGDRIRLDVAKGTLDVLVDEEEFEARKAGFEPLPPRYKTGVLAKYTKLVQSAAVGAVCT

SEQ ID NO: 7 - DNA, 1698 bp, Mycobacterium vanbaalenii
atgccctcatcgccagacatcaagccccgtagccgcgacgtcaccgacggcctggagaaggccgccgcccggggaatgctgcgcgcggtaggcatgggcgacgaggacttcgccaaaccgcagatcggcgtcggctcgtcctggaacgagatcaccccgtgcaacctgtcgctggaccggctcgccaaggcggtcaaggaaggcgtcttcgaggccggcggcttcccgatggagttcggcaccatctcggtttccgacggcatctcgatgggccatgaaggcatgcacttttcgttggtgtcgcgcgagatcatcgccgacagcgtcgagacggtgatgcaggccgagcgtctggacggctcggtgctgctcgccggatgcgacaagtcgctgcccggcatgctgatggccgctgcgcggctcgacctggccagcgtttttctctacgccggctcgatcctgcccggccgggtcaagctgtccgacggcagcgagaaggacgtcacgatcatcgacgccttcgaggccgtcggcgcctgcgcgcgcgggctgatgccccgcgaggacgtcgacgccatcgagcgtgcgatctgcccgggtgaaggcgcctgcggcggcatgtacaccgccaacacgatggccagcgccgccgaggcgctcggcatgtcgctgcccggctccgccgccccgccggccaccgaccggcgccgcgacggcttcgcccgcaagagcggcatggccgtcgtcgaactgctgcgccgaggcatcaccgcccgcgacatcctgaccaaggaggcgttcgagaacgcgatcgcggtcgtgatggcgttcggcggctccaccaacgcggtgctgcacctgctcgcgatcgcctacgaggccaacgtcaagctgaccctggaggacttcacccgcgtcggcgccaaggtgccgcacctggccgacgtgaaaccgttcggcgcgtacgtgatgaacgacgtcgaccggatcggcggcgttccggtcgtgatgaaggctctgctggacgccggtctgctgcacggggactgcctcaccgtcaccggtaagacgatggccgagaaccttgcccacatcgccccgcccgaccccgacggcaaggtgctgcgcgctctcagcaggccgatccatcccaccggcggcatcacgatcctgcacggctcgctggctcccgaaggtgcggtggtgaagtccgccgggttcgactccgacgtgttcgaaggcaccgcaagggttttcgagcgtgaacgggcagcgctcgacgcgctggaggacggcaccatcacgcacggcgacgtcgtggtcatccgttacgagggccccaagggcggtccgggcatgcgcgaaatgctcgccatcacaggcgcaatcaagggcgccgggctcggcaaggatgtgctgttgatgaccgacggccggttctccggcggcaccaccggtctgtgcgtcggccacatcgccccggaagcggtcgacggcggacccatcgccttcatcaaggacggcgacaagatccgtctcgacgtggccaagggcaccctcgacgttgtggtcgacaaggacgaattcgaggcgcgcaaagtcgggttcgagccgcttccccccgtctacaccaccggggtgctggccaagtacaccaagctcgtcggctcggcggccaccggcgcggtctgcacgtag

SEQ ID NO: 8 - protein, 565 aa, Mycobacterium vanbaalenii
MPSSPDIKPRSRDVTDGLEKAAARGMLRAVGMGDEDFAKPQIGVGSSWNEITPCNLSLDRLAKAVKEGVFEAGGFPMEFGTISVSDGISMGHEGMHFSLVSREIIADSVETVMQAERLDGSVLLAGCDKSLPGMLMAAARLDLASVFLYAGSILPGRVKLSDGSEKDVTIIDAFEAVGACARGLMPREDVDAIERAICPGEGACGGMYTANTMASAAEALGMSLPGSAAPPATDRRRDGFARKSGMAVVELLRRGITARDILTKEAFENAIAVVMAFGGSTNAVLHLLAIAYEANVKLTLEDFTRVGAKVPHLADVKPFGAYVMNDVDRIGGVPVVMKALLDAGLLHGDCLTVTGKTMAENLAHIAPPDPDGKVLRALSRPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFIKDGDKIRLDVAKGTLDVVVDKDEFEARKVGFEPLPPVYTTGVLAKYTKLVGSAATGAVCT

SEQ ID NO: 9 - DNA, 1707 bp, Nocardia farcinica
gtggccgagcagacgaacacccccgacctcaagccccgcagccgcgacgtcaccgacgggctggaacgcaccgccgcccgcggcatgctgcgcgcggtgggcatgggcgacgacgactgggagaagccgcagatcggcgtcgcctcctcctggaacgagatcaccccgtgcaacctgtcgctggaccggctcgcgcagggctgcaaggacggcgtgttcgccgccggtggcttcccgatgcagttcggcaccatctcggtctccgacggcatctcgatgggccacgagggcatgcacttctcgctggtgtcgcgcgaagtgatcgccgacagcgtggagacggtgatgcaggccgagcggctcgacggctcggtgctgctggccgggtgcgacaagtcgctgcccggcatgctgatggccgcggcccgcctcgacctggccagcgtgttcctctacgcgggctcgatcctgcccggcatcgccaagctctccgacggcaccgagcgcgaggtgacgatcatcgacgcgttcgaggcggtcggagcgtgcgcgcgcgggctgatgagccgggccgacgtcgacgccatcgaacgcgcgatctgtcccggcgagggcgcctgcggcggcatgtacaccgccaacacgatggccagcgcggccgaggcgctgggcatgtcgctgcccggcagcgccgcaccgcccgccaccgaccgccgccgcgacgggtacgcccgccgcagcggtcaggccgtggtcgagctgctgcgccgcggcatcaccgcccgcgacatcctcaccaaggaggcgttcgagaacgccatcgcggtggtgatggccttcggcggctcgaccaacgcggtgctgcacttgctcgcgatcgcgcacgaggcgcgggtggagctcaccctcgacgatttcgcgcgggtgggcaggcgggtgccgcacctggccgacgtcaagccgttcggcgcgcatgtgatgaccgatgtcgaccgcatcggcggcgtgccggtgatgatgaagaccctgctcgacgccgggctgctgcacggtgactgcctcaccgtcaccggccgcaccgtcgcggagaacctcgcccacatcgccccgcccgacccggacggcaaggtggtgcgcgcgctgaacgatccgatccatcccaccggcggcatcaccatcctgtccggctcgctggcgcccggcggggcggtggtgaaatccgccggtttcgacgaggacgtcttcaccggcacggccagggtcttcgatcgcgaacgcgccgcgatggacgcgctcgaggacggcaccatcaccgcaggcgacgtggtggtcatccgctacgagggccccaagggcggacccggcatgcgcgagatgctggccatcaccgccgccatcaagggcgcgggcctgggcaaggacgtgctgctgctcaccgacggccgcttctccggtggcaccaccggactgtgtgtcgggcacgtcgcgcccgaggcggtggacggtggtccgatcgcgttcgtccgcgacggcgaccgcatccggctcgacgtggccgcgggcaccctggacctgctggtggagcccgccgaactcgagcggcgcaaacaggactggcgaccgctgccgccgcgctacacccgcggcgtgctcgccaagtacaccaagctggtcggttcggcctcggtcggcgcggtctgcgactga

SEQ ID NO: 10 - protein, 568 aa, Nocardia farcinica
MAEQTNTPDLKPRSRDVTDGLERTAARGMLRAVGMGDDDWEKPQIGVASSWNEITPCNLSLDRLAQGCKDGVFAAGGFPMQFGTISVSDGISMGHEGMHFSLVSREVIADSVETVMQAERLDGSVLLAGCDKSLPGMLMAAARLDLASVFLYAGSILPGIAKLSDGTEREVTIIDAFEAVGACARGLMSRADVDAIERAICPGEGACGGMYTANTMASAAEALGMSLPGSAAPPATDRRRDGYARRSGQAVVELLRRGITARDILTKEAFENAIAVVMAFGGSTNAVLHLLAIAHEARVELTLDDFARVGRRVPHLADVKPFGAHVMTDVDRIGGVPVMMKTLLDAGLLHGDCLTVTGRTVAENLAHIAPPDPDGKVVRALNDPIHPTGGITILSGSLAPGGAVVKSAGFDEDVFTGTARVFDRERAAMDALEDGTITAGDVVVIRYEGPKGGPGMREMLAITAAIKGAGLGKDVLLLTDGRFSGGTTGLCVGHVAPEAVDGGPIAFVRDGDRIRLDVAAGTLDLLVEPAELERRKQDWRPLPPRYTRGVLAKYTKLVGSASVGAVCD

SEQ ID NO: 11 - DNA, 1695 bp, Rhodococcus sp.
atgagtaccccggatcccaaaccccgcagccgtgacgtcaccgacggattggagaagaccgcagcgcgcggaatgctccgtgcggtgggcatgggcgacgacgactgggggaaatcccagatcggcgtggcgtcgtcctggaacgagatcaccccctgcaacctgtcgctcgaccggctcgcgaaggccgtcaaggacggcgtccacgccgcaggcgggtatcccctcgagttcggcaccatctccgtgtccgacggcatctcgatgggacacgagggcatgcacttctccctcgtctcccgtgaggtgatcgccgacagcgtggaaacggtgatgcaggccgaacgcctcgacgggtcggtgctcctcgccggttgcgacaagtccctgcccggcatgctgatggccgcggcccgcctcgacctcgcgagcgtgttcctctacgccggttcgatcctgcccggtgtcgcaaaaatgtccgacggcaccgaacgcgacgtcaccatcatcgacgcgttcgaggcggtcggcgcctgttcgcgcggactgatgagccgtgaggacgtcgacgccatcgagcgtgccatctgtcccggcgagggcgcgtgcggcggaatgtacaccgcgaacacgatggccagtgccgccgaggcgctcggcatgtcgctgcccggcagcgcctccccgcccgccaccgaccgtcgtcgcgacggattcgcgaggcgcagcggtgaagccgtcgtcgaactgctccgccgcggcatcaccgccagggacatcctcaccaaggaagcgttcgagaacgccatcgccgtggtcatggccttcggcggttccaccaacgccgtcctgcacctgctggcgatcgcgagcgaagcggatgtggaactgaccctcgacgacttctcccgcgtcggcgcccgcgtcccgcacctcgcggacgtcaaaccgttcggcaagcacgtgatgaaggacgtcgaccacatcggcggcgtccccgtcatcatgaaggccctgctcgacgccgggatgctgcacggcgactgcctcaccgtcaccggcaagaccatggccgagaacctgtcggccatcgcccctcccgacccggacggcaaggtgctccgcgcgatgagttcgcccatccacccgaccggcggaatcacgatcctcaaggggtccctcgccccgggcggcgcggtggtgaagtcggccgggttcgactccgacgtcttcaccggcaccgcccgcgtcttcgaacgggaacgcgccgcgatggatgccctcgaggacggcaccatcacgaacggcgacgtcgtggtcatccgctacgagggccccaagggcggtcccggcatgcgcgagatgctcgcgatcaccggcgcgatcaagggcgccgggctgggcaaggacgtcctcctgctcaccgacggccgattctccggcggcaccaccggcctgtgcgtcggccacgtggcaccggaagccgtcgacggcggtcccatcgcgttcgtccgcgacggcgaccagatccgactggacgtcggaacgggcaccctcgaactgctcgtcgacgaagaggaactcgccggccgcaagaacgggtgggagcctctgcccccgcgctacacccgcggggtcctggccaagtacacgaagctcgtcggttccgcctcgggcggcgccgtctgcgggtag

SEQ ID NO: 12 - protein, 564 aa, Rhodococcus sp.
MSTPDPKPRSRDVTDGLEKTAARGMLRAVGMGDDDWGKSQIGVASSWNEITPCNLSLDRLAKAVKDGVHAAGGYPLEFGTISVSDGISMGHEGMHFSLVSREVIADSVETVMQAERLDGSVLLAGCDKSLPGMLMAAARLDLASVFLYAGSILPGVAKMSDGTERDVTIIDAFEAVGACSRGLMSREDVDAIERAICPGEGACGGMYTANTMASAAEALGMSLPGSASPPATDRRRDGFARRSGEAVVELLRRGITARDILTKEAFENAIAVVMAFGGSTNAVLHLLAIASEADVELTLDDFSRVGARVPHLADVKPFGKHVMKDVDHIGGVPVIMKALLDAGMLHGDCLTVTGKTMAENLSAIAPPDPDGKVLRAMSSPIHPTGGITILKGSLAPGGAVVKSAGFDSDVFTGTARVFERERAAMDALEDGTITNGDVVVIRYEGPKGGPGMREMLAITGAIKGAGLGKDVLLLTDGRFSGGTTGLCVGHVAPEAVDGGPIAFVRDGDQIRLDVGTGTLELLVDEEELAGRKNGWEPLPPRYTRGVLAKYTKLVGSASGGAVCG

SEQ ID NO: 13 - DNA, 1695 bp, Mycobacterium ulcerans
atgccagaagccgatatcaagccccgtagccgcgacgtcactgacggactggaaaaagccgctgcccgtggcatgttgcgggcggtaggcatggtcgacgaagacttcgccaaggcacagatcggggttgcctcgtcctggaacgagattacgccgtgcaacctctcgctggaccggctggccaagtcggtgaaagagggggtgttcgccgcgggcggctacccgcttgagttcggcacgatttcggtctccgacggcatttcgatgggtcacgagggcatgcacttctccctggtgtcgcgcgaagtgatcgccgacagcgtggaaaccgtgatgcaggccgagcgcctcgacggctcggtgctgctggccggatgcgacaaatccctgcccggaatgctgatggccgccgcccgtttggatttggcgtcggtgtttctctacgcgggctcgatccttccgggggtcgccaagctctccgacggcagcgaacgcgaggtcaccatcatcgacgcgttcgaagcggtcggcgcgtgctcgcgagggttgatgagccgagccgacgtcgacgccatcgagcgcgcgatctgccccggcgagggtgcctgtggcgggatgtacacggccaacacgatggccagtgccgctgaagcacttggcatgtcgctgccgggcagcgcggcgcccccggccaccgaccgccgccgcgacgggttcgcccggcaaagcggtcaagccgtcatcgaattgctgcgccagggcattaccgctcgcgacatcatgacccgggaggcgttcgagaacgccatcgcggtggtgatggcattcggcggctcgaccaatgcggtgctgcacctgctggcgatcgcccatgaggccaacgtcgagctcacgctcgacgacttcagccggatcggctcgaaggtgccgcacctagccgatgtcaagccgttcggccgccatgtgatgtcccacgtcgaccacatcggcggtgtgccggtggtcatgaagactttgctggatgccggcctgctgcacggggattgcctgaccgtgaccggccggaccgtggccgagaacctggaggccattgctccgccggacccggacggcaaggtgctacgcgcgctgatcaacccgatccatgcgaccgggggcatcaccatcctgcgtggatccctggcccccgaaggtgccgtggtcaagacggccggcttggacaccgatgtattcgaaggaacggcacgggttttcgacggcgagcgggccgcgctggatgccctcgaggacggcaccatcacccacggtgacgtggtggtgatccgttacgagggacccaagggcggccccgggatgcgggagatgctcgccatcaccggcgcgatcaagggcgccgggctcggcaaagacgtgctgctgttgaccgacggtcgattctccggcggcacaacgggcttctgtgtgggacacatcgcacccgaggcggtggatgccggaccgatcgcgttcgtgcgcgacggcgaccggatccggctcgacgttgccggccggacgctcgacgttctgaccgacccgccagagttcgcggcccgtcaacagaatttcactcctccggcgccgcgttacaagaccggcgtactggccaagtacgtcaagctggtcggctccgccgcgatcggcgcggtctgcggctaa

SEQ ID NO: 14 - protein, 564 aa, Mycobacterium ulcerans
MPEADIKPRSRDVTDGLEKAAARGMLRAVGMVDEDFAKAQIGVASSWNEITPCNLSLDRLAKSVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACSRGLMSRADVDAIERAICPGEGACGGMYTANTMASAAEALGMSLPGSAAPPATDRRRDGFARQSGQAVIELLRQGITARDIMTREAFENAIAVVMAFGGSTNAVLHLLAIAHEANVELTLDDFSRIGSKVPHLADVKPFGRHVMSHVDHIGGVPVVMKTLLDAGLLHGDCLTVTGRTVAENLEAIAPPDPDGKVLRALINPIHATGGITILRGSLAPEGAVVKTAGLDTDVFEGTARVFDGERAALDALEDGTITHGDVVVIRYEGPKGGPGMREMLAITGAIKGAGLGKDVLLLTDGRFSGGTTGFCVGHIAPEAVDAGPIAFVRDGDRIRLDVAGRTLDVLTDPPEFAARQQNFTPPAPRYKTGVLAKYVKLVGSAAIGAVCG

SEQ ID NO: 15 - DNA, 1728 bp, Mycobacterium avium
atgcccaccaccgattcggcgcgcgccgccgacatcaagcagcccgacatcaagccgcgcagtcgtgacgtcaccgacggcctggagaaggccgccgcccgggggatgctgcgggcggtaggcatgggcgacgaggacttcgccaagccgcagatcggggtggcgtcgtcctggaacgagatcacgccgtgcaacctgtcgctggaccggctggccaaggcggtcaaggaaggcgtcttcgccgcgggcggctacccgctggagttcggcaccatctcggtgtccgacggcatctcgatgggccacgagggcatgcacttctcgctggtgagccgcgaggtgatcgccgacagcgtcgagacggtgatgcaggccgagcgcctggacggctcggtgctgctggccggctgcgacaagtcgctgcccggcatgctgatggccgcggcccgcctggacctggcctcggtgttcctctacgccggctcgatcctgcccggggtggccaagctgtccgacggcagcgagcgcgaggtgacgatcatcgacgcgttcgaggccgtcggcgcgtgcgcgcgcgggctgatgccgcgcgaggacgtcgacgccatcgagcgggccatctgtcccggcgagggcgcctgcggcggcatgtacacggccaacaccatggccagcgccgccgaggcgctggggatgtcgctgccgggcagcgcggccccgccggccaccgaccgccgccgcgacggcttcgcccggcgcagcggccaggccgtcgtcgagctgctgcgccgcggcatcaccgcccgcgacatcctcaccaaggaggcgttcgagaacgcgatcgcggtggtgatggcgttcggcggctccaccaacgcggtgctgcacctgctggccatcgcccacgaggccgacgtggcgctgtcgctcgacgacttcagccggatcgggtcgaaggtgccgcacctggccgacgtcaagccgttcggccggcacgtgatgaccgacgtcgaccacatcggcggcgtgccggtgatgatgaaggcgctgctggacgccgggctgctgaacggcgactgcctgacggtgaccggtgcgacggtggcgcagaacctggccgcgatcgccccgcccgacccggacggcaaggtgctgcgggcactcagcgatccgttgcacccgaccggcggcatcaccatcctgcgcgggtcgctggcgcccgagggcgcggtggtcaagtccgccggcttcgattccgacgtgttcgaaggcaccgcaagggttttcgacggcgagcgggccgcgctggacgcgctggaggacggcaccatcaccaagggcgacgcggtggtgatccggtacgagggccccaagggcgggcccgggatgcgcgagatgctcgccatcaccggcgcgatcaagggcgccgggctgggtaaggacgtgctgttactcaccgacggccgcttctccggcgggacgacgggactgtgtgtcggccacatcgcgcccgaggcggtggacgcagggccgatcgcctttctgcgcgacggcgaccgcatccgcctggacgtcgccaaccgggttctggacgtactcgtcgatccggccgaattcgactctcggcgaacaggtttcaccccgccgccgccccgctacaagaccggggtgctggccaagtacgtcaagctcgtcggttccgcggcgatcggcgccgtctgcggctag

SEQ ID NO: 16 - protein, 575 aa, Mycobacterium avium
MPTTDSARAADIKQPDIKPRSRDVTDGLEKAAARGMLRAVGMGDEDFAKPQIGVASSWNEITPCNLSLDRLAKAVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACARGLMPREDVDAIERAICPGEGACGGMYTANTMASAAEALGMSLPGSAAPPATDRRRDGFARRSGQAVVELLRRGITARDILTKEAFENAIAVVMAFGGSTNAVLHLLAIAHEADVALSLDDFSRIGSKVPHLADVKPFGRHVMTDVDHIGGVPVMMKALLDAGLLNGDCLTVTGATVAQNLAAIAPPDPDGKVLRALSDPLHPTGGITILRGSLAPEGAVVKSAGFDSDVFEGTARVFDGERAALDALEDGTITKGDAVVIRYEGPKGGPGMREMLAITGAIKGAGLGKDVLLLTDGRFSGGTTGLCVGHIAPEAVDAGPIAFLRDGDRIRLDVANRVLDVLVDPAEFDSRRTGFTPPPPRYKTGVLAKYVKLVGSAAIGAVCG

SEQ ID NO: 17 - DNA, 1728 bp, Mycobacterium tuberculosis
atgccgcaaaccaccgacgaagccgcttccgtctcgacggtcgccgacatcaagccccgcagtcgagacgtcaccgacggcctggagaaggccgctgcccggggcatgttgagggcggtgggcatggacgacgaagacttcgcgaagccacagatcggggtcgcgtcgtcgtggaacgaaatcacgccgtgcaatctctcattggaccggctggccaacgcggtcaaggagggggtgttttcggccggcggctatccgcttgagttcggcacgatctcggtttcggacggcatctccatgggtcatgaggggatgcacttctcgctggtttcccgtgaggtgatcgccgacagcgtcgaagtcgtgatgcaggccgaacgactcgacggttcggtgctgctggccggatgcgacaaatcgctgcccggaatgctgatggccgccgcacgactggatctggcggcggtgttcctctacgcgggctctattttgcccggccgggccaagctctccgacggtagcgaacgagacgtcaccatcattgacgccttcgaggcggtcggagcgtgctctcgcggtttgatgagtcgcgccgacgtcgatgccatcgagcgggcaatctgccccggcgaaggggcatgcggcggcatgtacaccgctaacaccatggccagcgccgccgaggcgctcggcatgtcgttgccgggcagcgcggcaccgccggcgaccgaccgccggcgcgacgggttcgcgcgtcgcagcgggcaggccgtcgtcgagctgctgcgccgcggcatcaccgcccgcgacatcctcaccaaggaggcgttcgagaacgccatcgcggtgggaatggcgttcggcggctcgaccaacgcggtgctgcatctgctggccatcgcccacgaggccaacgtcgcactatcgcttcaggacttcagccggatcgggtcgggggtgccgcatttggccgatgtcaagccgttcggccgccatgtgatgtccgacgtcgatcacatcggcggtgtgccggtggttatgaaggcgctgctggacgccggtctgctacacggcgactgcctgacggttaccggtcacaccatggccgagaatctggctgccatcaccccgccggatccagatggcaaggtgctacgtgcgttggcaaacccgatccacccgagcggtggcatcaccatcctgcacggatcgctggcacccgaaggtgcggtggtcaagaccgccggattcgattccgacgtattcgaaggcaccgcaagagttttcgacggcgagcgcgctgcgctggacgcccttgaggatggcaccattaccgtgggcgacgccgtggtaatccggtacgaaggacccaagggcggccccgggatgcgcgaaatgctcgccatcacaggcgcgatcaaaggcgcaggactcggtaaagatgttctactgctgaccgacggccggttctccggtggaaccaccggcctgtgcgttggccacatcgcaccggaggcggtcgacggcggaccgatcgcacttctgcgcaacggcgaccggatccggctcgacgtggccggccgcgttctcgatgtgttggccgatccggccgaattcgcgtcccgacaacaggatttcagtcctccaccgccgcgctacactactggcgtactgtccaagtacgtcaagctggtcagctctgccgcggtcggcgcggtctgcggctag

SEQ ID NO: 18 - protein, 575 aa, Mycobacterium tuberculosis
MPQTTDEAASVSTVADIKPRSRDVTDGLEKAAARGMLRAVGMDDEDFAKPQIGVASSWNEITPCNLSLDRLANAVKEGVFSAGGYPLEFGTISVSDGISMGHEGMHFSLVSREVIADSVEVVMQAERLDGSVLLAGCDKSLPGMLMAAARLDLAAVFLYAGSILPGRAKLSDGSERDVTIIDAFEAVGACSRGLMSRADVDAIERAICPGEGACGGMYTANTMASAAEALGMSLPGSAAPPATDRRRDGFARRSGQAVVELLRRGITARDILTKEAFENAIAVGMAFGGSTNAVLHLLAIAHEANVALSLQDFSRIGSGVPHLADVKPFGRHVMSDVDHIGGVPVVMKALLDAGLLHGDCLTVTGHTMAENLAAITPPDPDGKVLRALANPIHPSGGITILHGSLAPEGAVVKTAGFDSDVFEGTARVFDGERAALDALEDGTITVGDAVVIRYEGPKGGPGMREMLAITGAIKGAGLGKDVLLLTDGRFSGGTTGLCVGHIAPEAVDGGPIALLRNGDRIRLDVAGRVLDVLADPAEFASRQQDFSPPPPRYTTGVLSKYVKLVSSAAVGAVCG

SEQ ID NO: 19 - DNA, 1695 bp, Mycobacterium lepraea
atgatgccccctgacatcaaaccccgcagccgcgacgttaccgatggcctggagaaggccgctgctcgtggcatgttgcgcgcagtcggcatgaacgatgacgacttcgccaaggcgcagatcggagttgcgtcatcatggaacgagatcacaccttgcaatctctcgctggaccgcctggccaaggcggtcaaggagggggtattctcggccggcggttatccgcttgagttcggaacaatttcggtttccgacggcatctcgatggggcaccaggggatgcacttctcgctggtgtcgcgcgaggttatagcggacagcgtcgaaaccgtaatgcaggccgagcgcctcgacggctcagtgcttttggctggctgcgataaatcactacccggaatgctgatggccgccgcacgtctcgacctcgcgtcggtatttctctacgccggctcgatcttgcccggacgaaccaagctctccgacggcaccgaacacgaagtcacgctcatcgacgcattcgaagcggtcggcgcgtgttctcgcggattaatgccccgcgctgatgtcgacgccatcgagcgggcgatctgccccggcgagggggcatgcggtggcatgtacactgccaacactatggccagcgcagcagaggcgctgggtatgtccttgccgggcagcgctgcgccgccggcaacagaccgtcgccgtgatggcttcgcgcggcgtagcgggcaggccgtcatcgaactgctgcgtcgcggtataaccgctcgcgacatccttaccaaggaagcgtttgagaacgcgatcgcggtggtgatggcgttcggtggctcgaccaacgcgatcctgcatctactggccattgcccatgaggccgacgtcaccttgtcgctcgaggacttcagtcggatcggatttaaggtgccgcatatagccgacgttaagccgttcggccggcacgtgatgttcgacgtcgaccacatcggtggtgtgccggtggtaatgaaagcacttctggacgcaggtctactgcacggtgattgcctgacggtgaccggtcagacgatggccgagaacctagcctccattgccccgccagacccggatggccaggtgatccgcacgttgcataatccaattcatccgacgggaggcattacgatcctgcgtggatcgttggcacctgatggcgcggtggttaagacggctggactcgactccgatgtgttcgaaggaactgcaagggttttcgacggagaacgggccgcgttggacgcactcaaggacggcaccatcgccaaaggcgatgttgtggttatccgctatgaaggcccgaaaggcggcccggggatgcgcgaaatgctagccatcaccggtgccatcaaaggtgccgggctaggcaaagatgttctgctacttactgacggcaggttctctggcggaacgaccggcttttgcgtaggacacatcgcgccggaagctgtcgaagcgggaccaatcgcattcctgcgtgacggcgaccgggtcctgctagacgttgtcggctgctccctcgatgtgctggtcgatccagtcgaattttcctctcggaaaaaggatttcattcctcctgcgccacgctacaccaccggtgtgcttgccaagtacgtcaagctcgtcagttcggcgacggtcggcgcggtctgcggttag

SEQ ID NO: 20 - protein, 564 aa, Mycobacterium lepraea
MMPPDIKPRSRDVTDGLEKAAARGMLRAVGMNDDDFAKAQIGVASSWNEITPCNLSLDRLAKAVKEGVFSAGGYPLEFGTISVSDGISMGHQGMHFSLVSREVIADSVETVMQAERLDGSVLLAGCDKSLPGMLMAAARLDLASVFLYAGSILPGRTKLSDGTEHEVTLIDAFEAVGACSRGLMPRADVDAIERAICPGEGACGGMYTANTMASAAEALGMSLPGSAAPPATDRRRDGFARRSGQAVIELLRRGITARDILTKEAFENAIAVVMAFGGSTNAILHLLAIAHEADVTLSLEDFSRIGFKVPHIADVKPFGRHVMFDVDHIGGVPVVMKALLDAGLLHGDCLTVTGQTMAENLASIAPPDPDGQVIRTLHNPIHPTGGITILRGSLAPDGAVVKTAGLDSDVFEGTARVFDGERAALDALKDGTIAKGDVVVIRYEGPKGGPGMREMLAITGAIKGAGLGKDVLLLTDGRFSGGTTGFCVGHIAPEAVEAGPIAFLRDGDRVLLDVVGCSLDVLVDPVEFSSRKKDFIPPAPRYTTGVLAKYVKLVSSATVGAVCG

SEQ ID NO: 21 - DNA, 1692 bp, Kineococcus radiotolerans
gtgagcgtcgacatcaagccccgcagtcgccaggtcaccgacggtctggaggcgaccgcctcgcgcggcatgctccgcgccgtcggcatgggcgacgacgactgggagaagccccagatcggggtggcctccagctggaacgagatcaccccctgcaacctgtccctggaccgcctcgcgaaggccgtcaaggacggcgtgcactccgcccacggcttcccgatggagttcggcaccatctccgtctccgacggcatctcgatgggccacgaggggatgcactactccctcgtctcgcgcgaggtcatcgccgactccgtcgagaccgtcatgagcgccgagcgcctcgacgggtccgtcctgctcgccggctgcgacaagtccctgccggggatgctcatggccgccgcgcgcctggacctggccagcgtcttcctctacgccggcacgatcctgcccgggcgggccaagctgtccgacggcagcgagcacgaggtcaccctcatcgacgccttcgaggccgtcggggcgtgcgcgcgggggctgatgtcccgcgaggacgtcgacgtcatcgagcgcgccatctgccccggcgagggggcctgcgggggcatgtacaccgcgaacacgatggccgccgcggccgaggcgctggggatgtccctgcccggcagcgcggccccgcccgcgaccgaccgccgtcgcgacgggttcgcccgccgctccggcgaggccgtggtgaacctgctctcgaagggcatcaccgcccggcagatcctcaccaaggaggcgttcgagaacgccatcgccgtcgtcatggccctgggcggctccaccaacgccgtcctgcacctgctggccatcgcctacgaggccgaggtcgacctcaccctcgccgacttcgaccgcgtcgccgcgaaggtcccgcacctggccgacctcaagcccttcggccgccacgtcatggtcgacgtcgaccgcatcggcggcatccccgtcgtcatgcgcgcgctgctggacgcgggcctgctgcacggggactgcctgacggtgaccgggaggacgatggccgagaacctcgccgacatcgccccgcccgacgtcgacggcgtcgtgctgcgctcgctgcaggaccccatccacaagaccggcggcatcacgatcctctccggcaacctcgcccccggcggcgcggtggtgaagagcgcgggcttcgactccgacgtcttcgagggcaccgcgcgggtcttcgagcgcgagcgcgccgccctggacgccctggaggacggcacgatctccgccggcgacgtcgtcgtcatccgctacgagggccccaagggcggcccggggatgcgcgagatgctcgccatcaccggcgcgatcaagggcgcgggcctgggcaaggacgtgctgctcatgaccgacgggcgcttctccggcgggacgacgggcctgtgcgtggggcacgtggcccccgaggccgtcgacgccggtcccatcgcgttcgtgcgcgacggggaccggatccgcctggacgtcgccggcaagaccctcgaggtgctggtggacgaggaggagctcgccgcccgccgcgagggctgggagccgctgcccccggtcttcaagcgcggggtgctggccaagtacgccaagcaggtccagtccgcctcgctcggggccgtctgccgctga

SEQ ID NO: 22 - protein, 563 aa, Kineococcus radiotolerans
MSVDIKPRSRQVTDGLEATASRGMLRAVGMGDDDWEKPQIGVASSWNEITPCNLSLDRLAKAVKDGVHSAHGFPMEFGTISVSDGISMGHEGMHYSLVSREVIADSVETVMSAERLDGSVLLAGCDKSLPGMLMAAARLDLASVFLYAGTILPGRAKLSDGSEHEVTLIDAFEAVGACARGLMSREDVDVIERAICPGEGACGGMYTANTMAAAAEALGMSLPGSAAPPATDRRRDGFARRSGEAVVNLLSKGITARQILTKEAFENAIAVVMALGGSTNAVLHLLAIAYEAEVDLTLADFDRVAAKVPHLADLKPFGRHVMVDVDRIGGIPVVMRALLDAGLLHGDCLTVTGRTMAENLADIAPPDVDGVVLRSLQDPIHKTGGITILSGNLAPGGAVVKSAGFDSDVFEGTARVFERERAALDALEDGTISAGDVVVIRYEGPKGGPGMREMLAITGAIKGAGLGKDVLLMTDGRFSGGTTGLCVGHVAPEAVDAGPIAFVRDGDRIRLDVAGKTLEVLVDEEELAARREGWEPLPPVFKRGVLAKYAKQVQSASLGAVCR

SEQ ID NO: 23 - DNA, 1704 bp, Janibacter sp.
atgagcaagcccgacatcgacatcaagccccgtagccgcgacgtcaccgacggtctcgagaagaccgcggcccgaggaatgctccgtgccgtaggcatgggcgacgacgactgggtcaagccacagatcggtgtcgcgagctcctggaacgagatcaccccctgcaacctctctctcgaccgcctgtccaaggcagtcaaggacggcgtccacgctgccggtggctacccgctcgagttcggcacgatctcggtgtccgacggcatctcgatgggccacgagggcatgcacttctcgctcgtgtcgcgcgagatcatcgccgactccgtcgagaccgtcatgagtgccgagcgcctcgacggctcggtcctgctcgccggctgcgacaagtccctcccgggcatgctcatggctgcggcgcgcctcgacctcgcctcggtcttcctgtatgccgggtcgatccttcccgggatcgcgaagctctcggacggcaccgagaaggaggtcacgatcatcgacgccttcgaggccgtcggtgcagccaacgcgggcaagatgtcgctggccgacgtcgacgccatcgagcgcgcgatctgtccgggggagggcgcctgtggcggtttctacacggccaacaccatggctgcggtcgccgagtcgatcggcatgtccatcccgggttcggccgccccgccagccaccgaccgacgccgcgacgtgcacgcccgccgctccggtgaggccgtcgtcgagctcctgcgtcgcggcatcaccgcccgccagatcatgaccaagcccgcgttcgagaacgccatcgccgtcgtcatggccttcggtggctcgaccaacgccgtcctccacctgctcgccatggcccacgaggccgaggtcgacctcaccatcggcgacttccagcgcatcggcaaaaaggtcccgcacctcgccgacgtcaagccgttcggcgccttcgtcatgaaggacatcgaccacatcggtggcatccccgtcgtcatgaagtcgctgctcgaggccgacctcctcgatggcgacgcactcaccgtgaccggcaagaccgtcgccgagaacctcgacgagatcaagccgccgcacatcgacggtcgcgtgatccgcgagttcagcaacccgatccacaagaccgggggcctcaccatcctcaccggctccctcgcgcccgaaggtgcggtcgtgaagtcggccggattcgacaccgaggtcttcgagggcagcgcccgcgtcttcaacggcgagcgtgccgcgatggatgccgtcgagcagggtgccctcaagccccaggacgtcgtcgtcatccgctacgaagggcccaagggtggcccgggaatgcgcgagatgctcgccgtcaccggcgccatcaagggcgcgggtctcggcaaggacgtcctcctcctcaccgacggtcgcttctccggtggcacgaccggcctctgcgtcggacacgtggcccccgaggccgtcgacgagggccccatcgccttcgtccgtgacggagacggcatccgcctcgacgtcgcgaacggcactcttgacctcctcgtcgacgacgccgagctcgagcgccgccgcaccgagggcgtcacccatcccgagcccaagtacacccgcggcgtgctcgcgaagtaccgcaagctcgtcggctcggccagcaagggcgccgtctgcgactga

SEQ ID NO: 24 - protein, 567 aa, Janibacter sp.
MSKPDIDIKPRSRDVTDGLEKTAARGMLRAVGMGDDDWVKPQIGVASSWNEITPCNLSLDRLSKAVKDGVHAAGGYPLEFGTISVSDGISMGHEGMHFSLVSREIIADSVETVMSAERLDGSVLLAGCDKSLPGMLMAAARLDLASVFLYAGSILPGIAKLSDGTEKEVTIIDAFEAVGAANAGKMSLADVDAIERAICPGEGACGGFYTANTMAAVAESIGMSIPGSAAPPATDRRRDVHARRSGEAVVELLRRGITARQIMTKPAFENAIAVVMAFGGSTNAVLHLLAMAHEAEVDLTIGDFQRIGKKVPHLADVKPFGAFVMKDIDHIGGIPVVMKSLLEADLLDGDALTVTGKTVAENLDEIKPPHIDGRVIREFSNPIHKTGGLTILTGSLAPEGAVVKSAGFDTEVFEGSARVFNGERAAMDAVEQGALKPQDVVVIRYEGPKGGPGMREMLAVTGAIKGAGLGKDVLLLTDGRFSGGTTGLCVGHVAPEAVDEGPIAFVRDGDGIRLDVANGTLDLLVDDAELERRRTEGVTHPEPKYTRGVLAKYRKLVGSASKGAVCD

SEQ ID NO: 25 - DNA, 1704 bp, Nocardioides sp.
atgaccgagcccacctcccgccccgacatcaagccccgctcccgcgacgtcaccgacggcctggagaaggccgccgcgcgcggcatgctgcgggcggtaggcatgggcgacgaggacttcgcgaagccgcagatcggcgtgggctcgagctggaacgagatcaccccgtgcaacctgtccctggaccggctcgccaaggccgtgaagaacggcgtgcacgcggccggcggctacccgctggagttcggcaccatctcggtctccgacggcatctccatgggccacgagggcatgcacttctcgctggtctcccgcgaggtgatcgccgactcggtcgagaccgtgatgatggccgagcgcctggacggctcggtgctgctcgccggctgcgacaagtcgctgccgggcatgatgatggccgccgcccgcctcgacctggccagcgtgttcctctacgccggctcgacgatgcccgggcaggtggacggcaacgacgtcacgatcatcgacgcgttcgaggccgtcggggcgtgcctggccggcaagatcagccgcgacgaggtggaccggatcgagcgggccatctgtccgggcgagggcgcctgcggcggcatgtacaccgcgaacacgatggcctccatcgccgaggcgatcggcatgtcgctccccggctcggcggccccgccggcggtcgatcgccgacgcgacggcttcgcgcaccgctcgggggaggccgtggtcaacctgttgcgccagggcatcacggcccgccagatcatgactcgcgcggcgttcgagaacgcgatcacggtcgcgatggcgctcggcggctcgaccaacgccgtgctccacctgctcgcgatggctcgtgaggccgacgtcgacctcaccatcgacgacttcaaccggatcggtgacaaggtgccgcacctcggcgacctcaaaccgttcggcaagtacgtcatgaacgacgtcgacaagatcggcggcatccccgtcgtgatgaaggcactgctcgacgccggtctgatgcacggcgacgcgctcaccgtcaccggcaagaccctggccgagaacctcgccgagctggccccgccggagctcgatgacgaggtgatccgcaagctggaccggccgatccacaagaccggtgggctcacgatcctcaagggctcgctcgctcccgagggcgccgtggtcaagacggccggcttcgacgactccgtgttcaccggcaccgcccgcgtcttcgacggcgagcgggccgcgatggacgccctcgaggccgggcagatccagccccgcgacgtcgtggtgatccgctacgagggcccgaagggtggccccggcatgcgcgagatgctcgcgatcaccggcgcgatcaagggcgccggcctcggcaaggacgtcttgctgatcaccgacggcaggttctccggtggtacgacgggcctgtgcgtgggccacatcgcccccgaggccgtcgacggcggcccgatcgcgttcgtccgcgacggcgaccagatcaccctcgacgtcgccaaccggctgctcgaggtggaggtcgtcggtcccgatgccgaggccgagtgggagcgccgcaaggtcggctgggagccgaatccgcccaagtacacccgcggggtgctcggcaagtacgccaagatcgtccagtccgccgcgcacggcgccatcaccggctga

SEQ ID NO: 26 - protein, 567 aa, Nocardioides sp.
MTEPTSRPDIKPRSRDVTDGLEKAAARGMLRAVGMGDEDFAKPQIGVGSSWNEITPCNLSLDRLAKAVKNGVHAAGGYPLEFGTISVSDGISMGHEGMHFSLVSREVIADSVETVMMAERLDGSVLLAGCDKSLPGMMMAAARLDLASVFLYAGSTMPGQVDGNDVTIIDAFEAVGACLAGKISRDEVDRIERAICPGEGACGGMYTANTMASIAEAIGMSLPGSAAPPAVDRRRDGFAHRSGEAVVNLLRQGITARQIMTRAAFENAITVAMALGGSTNAVLHLLAMAREADVDLTIDDFNRIGDKVPHLGDLKPFGKYVMNDVDKIGGIPVVMKALLDAGLMHGDALTVTGKTLAENLAELAPPELDDEVIRKLDRPIHKTGGLTILKGSLAPEGAVVKTAGFDDSVFTGTARVFDGERAAMDALEAGQIQPRDVVVIRYEGPKGGPGMREMLAITGAIKGAGLGKDVLLITDGRFSGGTTGLCVGHIAPEAVDGGPIAFVRDGDQITLDVANRLLEVEVVGPDAEAEWERRKVGWEPNPPKYTRGVLGKYAKIVQSAAHGAITG

SEQ ID NO: 27 - DNA, 1722 bp, Renibacterium salmoninarum
atgagtgtggaaaccagtagcgaaaccggcaacaaaccagatatcaaaccgagaagccgcattgtcaccgacggaattgccgccgcgcctgctcgaggaatgctccgagccgttggctttggcgacgaggactttgcgaagccgcagattggcgtcgcgagttcgtggaacgaaattaccccctgcaatctctcccttgatcggctggccaaagccgtcaaagagggcgtgcatgccggcggcggcttcccgatgatctttggcacaatttcggtgtccgatggcatttcgatggggcacgaaggtatgcacttctcgcttgtctcccgcgaagtgattgctgactcggtagagactgttatgcaagcagaacgcatcgatggctcggtgctgcttgctggctgcgataagtcattgccgggcatgttgatggccgcagcccggctcaatgtgtccagtgttttcctctacgccggctcaatcatgcccggctgggtcaagcttgaagacggcacagagaaagacgtcacgcttattgacgcctttgaagctgtcggtgcctgcgcagccggcaaaatgtcggtgggggatctagaccgaatcgaacgggcaatttgtccgggcgaaggtgcctgcggtggtatgtacaccgcgaacactatggcctgtattggcgaggccttgggtatgtccttgcctggctcggctgcgccgccaagtgcggaccgccgtcgcgatatgttcgcgcaccgttctggcgaggctgttgttgagttgctccgccggggcattcgctcgcgcgacatcatgaccaaggaagcctttgagaacgcgattgcggtcacgatggcttttggcggctccacgaacgcagtgctgcacctacttgctattgctcgtgaggccgaggttgatctgcagcttgaggacttcaaccgaattggtgacaagatcccgcacctcggcgacctcaagccttttggccgatacgtgatgaacgacgtcgaccgggtgggcggcgtgccggtgataatgcgcgcgctgctcgatgccgggctactgcatggtgatgccttgaccgtgaccggtaagactctggccgaaaatcttgaagcgatcaatccgccagatctggatggcaagattttgcgtgcgttggataatccaatccacaaaactggtgggttgagtgtgctcaagggctcgcttgcacctggcggcgccgtggttaagaccgccgggttcgacgccgaggttttcgaaggcccggctcgggtttttgaacgcgaacaaggcgcactcgaagcgcttaaggctggcgaaatcaaagcgggcgacgtcgtcgtgatccgctatgaaggccctaaaggtgggccgggtatgcgcgaaatgctcgccatcactggcgcgatcaagggcgctggcctgggcaaagacgtgttgttgttgaccgacggtcggttctccggaggtacaacgggtctgtgcatcgggcacgtggcgccggaagctgtcgacgccgggccaatcgcctttgtgcaagacggcgacctaatccgggttgatatccccaacaagagtttcgatctcttggttgacgaagcagagctggaagctcggaaaatcggttgggagccgttgcctgctcgcttcactaaaggcgtgttggctaagtacgctaagcttgtgcactcggcttccgaaggcgcatactgcggctaa

SEQ ID NO: 28 - protein, 573 aa, Renibacterium salmoninarum
MSVETSSETGNKPDIKPRSRIVTDGIAAAPARGMLRAVGFGDEDFAKPQIGVASSWNEITPCNLSLDRLAKAVKEGVHAGGGFPMIFGTISVSDGISMGHEGMHFSLVSREVIADSVETVMQAERIDGSVLLAGCDKSLPGMLMAAARLNVSSVFLYAGSIMPGWVKLEDGTEKDVTLIDAFEAVGACAAGKMSVGDLDRIERAICPGEGACGGMYTANTMACIGEALGMSLPGSAAPPSADRRRDMFAHRSGEAVVELLRRGIRSRDIMTKEAFENAIAVTMAFGGSTNAVLHLLAIAREAEVDLQLEDFNRIGDKIPHLGDLKPFGRYVMNDVDRVGGVPVIMRALLDAGLLHGDALTVTGKTLAENLEAINPPDLDGKILRALDNPIHKTGGLSVLKGSLAPGGAVVKTAGFDAEVFEGPARVFEREQGALEALKAGEIKAGDVVVIRYEGPKGGPGMREMLAITGAIKGAGLGKDVLLLTDGRFSGGTTGLCIGHVAPEAVDAGPIAFVQDGDLIRVDIPNKSFDLLVDEAELEARKIGWEPLPARFTKGVLAKYAKLVHSASEGAYCG

SEQ ID NO: 29 - DNA, 1767 bp, Arthrobacter aurescens
gtgcaacagcgtcggcagtcgcccggtagacatagactttggaccatgagtgacaccacccagattgcgacagacagcacgccggacattaaaccccgcagccgggtggtgacagacggcattcacgcggcgcctgcccgcggcatgttccgtgcggtgggcatgggcgacgacgactttgccaaaccccaaatcggtgttgccagctcgtggaatgaaattaccccttgcaatctttccctgaatcgcctcgcacaaggcgccaaggaaggcgtccatgccggcggcggcttcccgatgcagttcggcacgatctccgtttcggatggtatttccatgggccacgagggcatgcacttctccctggtctcccgcgaagtcatcgccgactctgtggaaacagtgatgcaggccgagcgcattgacggctcggtgctcctggccggctgtgacaagtcccttccgggcatgctcatggctgctgcccgcttggacctcgcatccgtcttcctctacgccggctccatcatgccgggctgggtcaagctggaggacggctcggagaaggaagtcaccctcattgatgccttcgaggccgtgggtgcctgcgccgccggcaaaatgagcatggaagacctcacaaggatcgaaaaggccatctgtcccggcgaaggcgcctgcggcggtatgtacacggccaacaccatggcgtgcatcggcgaggccttgggcatgtccctcccgggttcagccgccccgccgtcggcagaccgccgtcgtgatgatttcgcacgcaagtccggcgaagccgtagtaaacctgctgcgcctgggcatcacggcccgcgacatcatgaccaaaaaggcgttcgagaatgccattgccgtcaccatggccttcggcggttccaccaacgccgtgctgcacttgctcgcgatcgcccgggaagccgaagtagagctgacgctggacgacttcaatcgcatcggcgacaaaattccgcaccttggggacctcaagcccttcggccgttatgtgatgaccgacgttgacaagatcggcggcgtgccggtcatcatgaaggcactgctcgacgccggactactgcacggcgactgcctcaccgttaccggcaagacgctcgcggaaaacctcgcctcgatcaacccgccggaccttgacggcaaaatcctccgtgcgctggacaacccgatccacaagaccggtggcatcaccatcctccacggctctatggctccggaaggagcggtagtgaagagtgccggttttgatgctgacgtctttgaaggaactgcacgcgttttcgaacgcgagcagggcgccctcagcgcgttggacaacggcgaaatcaacaagggagacgtagtggtcatccgctatgaaggccccaagggcggtcccggcatgcgggaaatgttggccatcaccggcgccatcaagggagcgggactcggcaaggatgtcctccttctcacggatggccggttctcgggtggcacaacgggtctgtgcatcggccacgttgcgcctgaagccgtggatggtggccccatcgcgttcgtgaaggacggtgaccgcatccgtgtagacatcgccgctcgctccttcgacctcctggtggacgaagccgagctcgaagcccgcaaagagggctggaagccactgcccgccaagttcaccaagggtgttcttgccaagtacgccaagcttgtccacagcgcctccaccggagcgtactgcggataa

SEQ ID NO: 30 - protein, 588 aa, Arthrobacter aurescens
MQQRRQSPGRHRLWTMSDTTQIATDSTPDIKPRSRVVTDGIHAAPARGMFRAVGMGDDDFAKPQIGVASSWNEITPCNLSLNRLAQGAKEGVHAGGGFPMQFGTISVSDGISMGHEGMHFSLVSREVIADSVETVMQAERIDGSVLLAGCDKSLPGMLMAAARLDLASVFLYAGSIMPGWVKLEDGSEKEVTLIDAFEAVGACAAGKMSMEDLTRIEKAICPGEGACGGMYTANTMACIGEALGMSLPGSAAPPSADRRRDDFARKSGEAVVNLLRLGITARDIMTKKAFENAIAVTMAFGGSTNAVLHLLAIAREAEVELTLDDFNRIGDKIPHLGDLKPFGRYVMTDVDKIGGVPVIMKALLDAGLLHGDCLTVTGKTLAENLASINPPDLDGKILRALDNPIHKTGGITILHGSMAPEGAVVKSAGFDADVFEGTARVFEREQGALSALDNGEINKGDVVVIRYEGPKGGPGMREMLAITGAIKGAGLGKDVLLLTDGRFSGGTTGLCIGHVAPEAVDGGPIAFVKDGDRIRVDIAARSFDLLVDEAELEARKEGWKPLPAKFTKGVLAKYAKLVHSASTGAYCG

SEQ ID NO: 31 - DNA, 1695 bp, Leifsonia xyli
atgcctcagatcgattggaaaccgcgttcgcgcgttgtcacggacgggatcgaagccaccacgagccgcgggatgctccgtgcggtcggcatgggggacgccgactgggagaagccgcagatcggcatcgcctcgtcctggaacgagatcacgccgtgcaacctctcgctcgaccggctggcccagggcgccaaagaaggcgtccactccggtggcggttatccgctgcaattcggtaccgtctcggtctccgacggtatctcgatggggcacgagggaatgcacttctcgctcgtctcccgtgaggtcatcgccgactcggtcgagacggtcatgatggccgagcggctcgacggcaccgtcctcctcgccggctgcgacaaatcgctgccgggcatgctgatggccgcggcccgtctcgacctctccgcgatcttcctctacgcgggctccatcgcgcccggctgggtcaaactcagcgacggcaccgagaaggacgtcacgatcatcgactcgttcgaggctgtcggtgcgtgcaaggccggcaagatgagcgaggaggacctcaaacgcatcgagtgcgccatagccccgggtgaaggagcctgcggcggcatgtacaccgcgaacaccatggcgtccgtcgccgaggcactcgggatgagcctgcccggctcggctgcgccgccctcggccgaccggcggcgcgactccttcgcccaccgctccggcgaggctgttgtctccctgctgaagcagggcatcacggctcgcgacatcctcaccaagaaggcgttcgagaacgccatcgcggtggcgatggccttcggcgggtcgacgaacgtcgtgcttcacctgctcgccatcgcgcgcgaggccgaggttgacctcaccatcgacgatttcaaccgcatcggcgagacggttccgcacatcggcgatctcaaaccgttcggcacgtacgtcatgaacgacgtcgaccgtcacggtggtgtcccggtcgtcatgaaggcgctcctggacgcgggcctgctgcacggggactgcctcaccgtgaccggcaagaccgtcgcggagaacctggcggagatcgacccgcccgcaccggacggcaccgtcctgcgctcgctggacaaccccatccacccgacaggggggctcacaatcctcaagggcacgctcgctccggagggcgccgttgtcaagacggctggtttcgacgccgaggtgttcgagggcccagcgcgcgtgttcgagcgcgagcgcgccgctatggacgctctcaccgcgggccggatcaacgccggcgatgtggtcgtcatctgctacgaagggccgaagggcggtcccgggatgcgcgagatgctcgcgatcaccgccaccatcaagggtgcaggcctcggcaaggatgtactactcttgacggacgggcgattctcaggcggcacaaccggcctgtgcatcggccacatagcacccgaagcggtggacgctggtcccatcgcattcgtgcgcgatggtgatttgatacgggtcgatatcgcggctcgctccctcgacctactggtcgacgagtcagagctgaccgcccgccgggacggctgggcgcctcttcctccgcgctatacccgtggcgttctcgcgaagtactccaagctcgttcgctccgctgcggagggtgcggtcaccgggtag

SEQ ID NO: 32 - protein, 564 aa, Leifsonia xyli
MPQIDWKPRSRVVTDGIEATTSRGMLRAVGMGDADWEKPQIGIASSWNEITPCNLSLDRLAQGAKEGVHSGGGYPLQFGTVSVSDGISMGHEGMHFSLVSREVIADSVETVMMAERLDGTVLLAGCDKSLPGMLMAAARLDLSAIFLYAGSIAPGWVKLSDGTEKDVTIIDSFEAVGACKAGKMSEEDLKRIECAIAPGEGACGGMYTANTMASVAEALGMSLPGSAAPPSADRRRDSFAHRSGEAVVSLLKQGITARDILTKKAFENAIAVAMAFGGSTNVVLHLLAIAREAEVDLTIDDFNRIGETVPHIGDLKPFGTYVMNDVDRHGGVPVVMKALLDAGLLHGDCLTVTGKTVAENLAEIDPPAPDGTVLRSLDNPIHPTGGLTILKGTLAPEGAVVKTAGFDAEVFEGPARVFERERAAMDALTAGRINAGDVVVICYEGPKGGPGMREMLAITATIKGAGLGKDVLLLTDGRFSGGTTGLCIGHIAPEAVDAGPIAFVRDGDLIRVDIAARSLDLLVDESELTARRDGWAPLPPRYTRGVLAKYSKLVRSAAEGAVTG

SEQ ID NO: 33 - DNA, 1704 bp, Marine actinobacterium
atgtctgagagtgattcgattgatatcaagccacgttcccgcacggtaaccgacggaattgaagcaacaacttcgcgcggaatgctgcgtgcagttggtatgggagatgccgactgggagaagccccagatcggtattgcgagctcgtggaacgagatcaccccctgcaatctgtcgctcgatcgcctcgctcaagcggcgaaagagggagtgcacgccggtggcgggtacccactgcagtttggaacgattagcgtttccgatggcatttcaatggggcacgaggggatgcacttctcactcgtgagtcgcgaagttatcgctgactccgttgaggttgtcatggaggcagagcgcctcgacggttcggtcacgctcgcgggctgcgacaagtcgcttcccggaatgctgatggctgcggcgcggctcaacctcgcctctgtcttcctctatgccggttcgatcgctcccggctgggtcaagctcagcgacggtaccgaaaaagacatcacgatcatcgactcgttcgaagcagtcggcgcagtcaaagctggccggatgagcgaagccgacgccaagcgcatcgagtgtgcttttgcgcccggcgagggtgcctgtggcggtatgtacacggccaacacgatggcgagcgttgcggaagccctgggaatgagtcttcccggctcggcgagcccagcatccgccgatcgtcgtcgcgactacttcgcgcaccgttcaggcgaagctgtcgtcaatcttctgcgcctcggtatcacttcgcgcgacatcatgacgaagaaggcttttgagaacgcgatcacggtagcaatggctcttggtggctccacgaacgttgtgctgcacatcctcgccatcgcgagcgaagccgaagttgaactcacgctcgatgacttcaatcgcatcggcgacaaggttccccacttgggcgacctgaagccgttcggccagtacgtcatgaacgatgttgaccgccacggcgggctcccggtgctcatgaaggcgctcatggaggaggggctcattcacggcgatgccctcacagtgacgggcaagactgttgccgaaaacttggccgagatggacatcgatcctctagatggcaaggttcttcgcaagttcgacaaccccatccaccccactgggggtctcacaattcttaagggttctttcgctcccgagggtgcagtcgtgaagacggcaggtttcgacgttgctgagttcgtgggccctgcccgcgtgttcgagcgcgagcgtgaagcactggatgctttgactgccggcacgatcgaggctggttctgttgtcgtcattcgctatgaaggacccaagggtggaccgggcatgcgcgagatgctcgcgatcacggcggccatcaagggcgctggactcggcaaagatgtactactcttaacagacggacgattctcaggcggcacaaccggactgtgtatcggccacatagctcccgaagcagtagacgcaggtcctattgccttcgtgcgcgatggtgatcttatacgggtcgatatcgcagctcgctcgctcgacttacttgtcgactccgctgagctcgaagcccgccgaaaaggctgggcccccctccctccgcgctacacgcgaggtgttctggccaagtattcgaagcttgttcagtccgccgctcgcggcgcggtcaccagttag

SEQ ID NO: 34 - protein, 567 aa, Marine actinobacterium
MSESDSIDIKPRSRTVTDGIEATTSRGMLRAVGMGDADWEKPQIGIASSWNEITPCNLSLDRLAQAAKEGVHAGGGYPLQFGTISVSDGISMGHEGMHFSLVSREVIADSVEVVMEAERLDGSVTLAGCDKSLPGMLMAAARLNLASVFLYAGSIAPGWVKLSDGTEKDITIIDSFEAVGAVKAGRMSEADAKRIECAFAPGEGACGGMYTANTMASVAEALGMSLPGSASPASADRRRDYFAHRSGEAVVNLLRLGITSRDIMTKKAFENAITVAMALGGSTNVVLHILAIASEAEVELTLDDFNRIGDKVPHLGDLKPFGQYVMNDVDRHGGLPVLMKALMEEGLIHGDALTVTGKTVAENLAEMDIDPLDGKVLRKFDNPIHPTGGLTILKGSFAPEGAVVKTAGFDVAEFVGPARVFEREREALDALTAGTIEAGSVVVIRYEGPKGGPGMREMLAITAAIKGAGLGKDVLLLTDGRFSGGTTGLCIGHIAPEAVDAGPIAFVRDGDLIRVDIAARSLDLLVDSAELEARRKGWAPLPPRYTRGVLAKYSKLVQSAARGAVTS

SEQ ID NO: 35 - DNA, 1695 bp, Clavibacter michiganensis
atgcctgagatcgacatgaagccccggagccgcgacgtcaccgacgggatcgaggccaccgcagcacgcggcatgctccgcgccgtcgggatgggcgacgaggactgggcgaagccccagatcggcgtcgcgagctcctggagcgagatcaccccctgcaacctcagcctcgaccgcctcgcgcagggcgccaaggagggcgtgcacgcgggcggcggctacccgctccagttcggcaccatctccgtcagcgacggcatctcgatgggccacgagggcatgcacttctcgctcgtctcgcgcgaggtcatcgccgacagcgtcgagaccgtcatgatggccgagcgcctcgacgggtccgtgctcctcgcgggctgcgacaagtcgctccccggcatgctcatggccgcggcccgcctcgacctctcctcggtgttcctctacgcgggatccatcgcccccggctgggtcaagctctcggacggcaccgagaaggaggtcaccatcatcgacgccttcgaggcggtcggcgcctgcaaggccggcacgatgagccaggaggacctgacccgcatcgagaaggccatctgcccgggcgagggcgcatgcggcggcatgtacacagcgaacaccatggcgagcgtggccgaggccctcggcatgagcctccccggatccgccgccccgccgagcgccgaccgccgccgcgactacttcgcgcaccggtcgggcgaggccgtcgtcaacctcatcgcggagggcatcaccgcgcgcgacatcatgacgaaggaggcgttcgagaacgccatctccgtggtcatggcgttcggcggatccaccaacgcggtcctccacctcctcgccatcgcgcgcgaggccgaggtcgacctgcagctgtccgacttcaaccgcatcgccgaccgcgtgccgcacctcggcgacctcaagccgttcggccgcttcgtcatgaacgacgttgaccgcgtcggcggcgtccccgtcgtcatgaaggccctgctcgacgcgggcctcctgcacggcgacgtcatgaccgtcaccggccgcaccatgcgcgagaacctcgaggcgatggacctcgcggagctcgacggcacggtcatccggaagatggacgacccgatccacgccaccggcggcatcagcgtcctgcacggctccctcgcccccgagggcgcggtcgtgaagacggccggcttcgacctcgacgtgttcgagggccccgcccgcgtcttcgagcgcgagcgcgccgcgatggacgcgctcaccgagggactcatctcgaagggcgacgtcatcgtcatccgctacgagggccccaagggcggccccggcatgcgcgagatgctcgccatcacgggcgccatcaagggagccggcctcggcaaggatgtactactcttgacggacggtcgattctcaggcggcacaaccggactgtgcatcggccacatggctcccgaagcggtggacgcaggtcccgtcgccttcgtgcgcgatggagaccggatccgtgtcgacatcgccgctcgcacgctcgacctactggtcgacgaggccgagctcgccgcccgccgtgaggggtgggcacctctcccgccgcgctacacgcgcggggtcctcgccaagtacgccaagctcgtgcactcggccgccgagggcgcgatcacgggatga

SEQ ID NO: 36 - protein, 564 aa, Clavibacter michiganensis
MPEIDMKPRSRDVTDGIEATAARGMLRAVGMGDEDWAKPQIGVASSWSEITPCNLSLDRLAQGAKEGVHAGGGYPLQFGTISVSDGISMGHEGMHFSLVSREVIADSVETVMMAERLDGSVLLAGCDKSLPGMLMAAARLDLSSVFLYAGSIAPGWVKLSDGTEKEVTIIDAFEAVGACKAGTMSQEDLTRIEKAICPGEGACGGMYTANTMASVAEALGMSLPGSAAPPSADRRRDYFAHRSGEAVVNLIAEGITARDIMTKEAFENAISVVMAFGGSTNAVLHLLAIAREAEVDLQLSDFNRIADRVPHLGDLKPFGRFVMNDVDRVGGVPVVMKALLDAGLLHGDVMTVTGRTMRENLEAMDLAELDGTVIRKMDDPIHATGGISVLHGSLAPEGAVVKTAGFDLDVFEGPARVFERERAAMDALTEGLISKGDVIVIRYEGPKGGPGMREMLAITGAIKGAGLGKDVLLLTDGRFSGGTTGLCIGHMAPEAVDAGPVAFVRDGDRIRVDIAARTLDLLVDEAELAARREGWAPLPPRYTRGVLAKYAKLVHSAAEGAITG

SEQ ID NO: 37 - DNA, 1707 bp, Saccharopolyspora erythraea
gtgagcaccagcactgatggcacaggacagtcggggcgtggtctgaagccccgcagcggtgacgtgaccgaggggatcgaacgtgctgcggcgcgggggatgctccgggcggtcgggatgcaggacgccgacttcgcgaagccccagatcggggtggcgtcctcgtggaacgagatcacgccgtgcaacctgtcgttgcagcggctcgcgcaggcgagcaaggaaggtgtgcacgcggccggcggcttcccgatggagttcgggacgatctcggtctcggacgggatctcgatgggtcacgtcggcatgcactactcgctcgtgtcccgcgaggtcatcgccgactccgtcgagacggtgatggaggcggagcggctcgacgggtccgtgctgctcgccggctgcgacaagagcctgccgggcatgctgatggccgcggcgcgcctggacgtcgcggcggtcttcgtctacgccgggtcgatcctccccgggcgggtcgacgaccgcgaggtcaccatcatcgacgcgttcgaggcggtgggcgcctgcgcccgcggcctgatcagcgaggccgaggtcgaccgcatcgaacgcgccatctgcccgggagagggcgcgtgcggcggcatgtacaccgcgaacaccatggcctgcgcggcagaggcgatgggcatgtcgctgccgggatcggcgagcccgccgtcggtagaccggcggcgcgacgccggagcccgggaggccgggcgcgcggtggtcgggatgatcgagcgcggactgaccgcgcggcagatcctgaccaaggaggcgttcgagaacgccatcgccgttgtgatggcgttcggtggctccaccaatgccgtgctgcacctgttggcgatcgcgcgggaagccgaggtcgacctgacgctcgacgacttcaaccgcatcggtgaccgcgtcccgcacctcgccgacgtcaagcccttcggtcggcacgtgatgaccgcggtggaccggatcggtggcgtgccggtcgtgatgaaggccctgctcgacgccgggttgctgcacggcgactgcatgacggtcaccgggaagacggtggccgagaacctcgccgagctggatccgccggagctcgacggtgaggtcctgcacaagctgtcgaacccgctgcacccgaccggcgggctgacgattctgcgcggatcgctcgccccggaaggtgcggtggtcaagagcgccgggttcgactccgccactttcgaaggcacggcgcgggttttcgacggcgagcagggtgcgatggacgccgtcgaagacggctcgttgaaggccggcgacgtggtggtgatccggtacgaagggccgcgcggtggtccgggtatgcgcgagatgctcgcggtcaccggtgccatcaagggcgcgggcctgggcaaggacgtcctgctgctgacggacggccgtttctccggcggtaccacggggctgtgcatcggtcacgtggctcccgaggcgaccgacggcgggccgatcgcgttcgtgcgcgacggggacccgatccggctcgacctggcgggccggacgctcgacctgctggtggacgaagccgaactcgcgcgccggaaggaaggctgggtgccgcgggagccgaagttccggcagggcgtgctcgggaagtacgcgcggctggtccggtcggcggcggtgggcgcggtctgctcctga

SEQ ID NO: 38 - protein, 568 aa, Saccharopolyspora erythraea
MSTSTDGTGQSGRGLKPRSGDVTEGIERAAARGMLRAVGMQDADFAKPQIGVASSWNEITPCNLSLQRLAQASKEGVHAAGGFPMEFGTISVSDGISMGHVGMHYSLVSREVIADSVETVMEAERLDGSVLLAGCDKSLPGMLMAAARLDVAAVFVYAGSILPGRVDDREVTIIDAFEAVGACARGLISEAEVDRIERAICPGEGACGGMYTANTMACAAEAMGMSLPGSASPPSVDRRRDAGAREAGRAVVGMIERGLTARQILTKEAFENAIAVVMAFGGSTNAVLHLLAIAREAEVDLTLDDFNRIGDRVPHLADVKPFGRHVMTAVDRIGGVPVVMKALLDAGLLHGDCMTVTGKTVAENLAELDPPELDGEVLHKLSNPLHPTGGLTILRGSLAPEGAVVKSAGFDSATFEGTARVFDGEQGAMDAVEDGSLKAGDVVVIRYEGPRGGPGMREMLAVTGAIKGAGLGKDVLLLTDGRFSGGTTGLCIGHVAPEATDGGPIAFVRDGDPIRLDLAGRTLDLLVDEAELARRKEGWVPREPKFRQGVLGKYARLVRSAAVGAVCS

SEQ ID NO: 39 - DNA, 1677 bp, Acidothermus cellulolyticus
atgcgcgctcagcccgatctcaaaccgcgcagccgtgacgtcaccgatgggctggagcgggccgcggcccgcggcatgctccgcgccgtcggaatgaccgatgcggactgggagaaaccccagatcggagtggcgagttcctggaacgagataacgccctgcaacctctccctcgaccggctcgcgcaggcggccaaggagggcgtgcacgccgccggcgggtatccgctggagttcgccaccatctcggtttccgacggcatctccatgggccatgagggaatgcatttctcgctgatttcccgcgaagtcatcgccgattccgtcgaaaccgtcttcatggctgagcgcttcgacggcgccgtcctgcttgccggttgcgacaagtccgaacccggcatgctgatggcggccgcccggcttgacctggcagcggttttcctctatgccggcagcacgttgccggggaaactcggggaccgggacatcaacatcgtcgatgcgttcgaggctgtcggcggttgccttcgcggcctggtgagccgggaagaggtcgacgccatcgaacggaatttctgtccggtcgaaggggcctgcgcgggcatgttcaccgccaacacgatggccagcgcggcggaagcgctcggcatgtcattgcccggttcggcctcgccgcccgcgccggaccgccggcgcgacggtttcgcccgggcctccggggaggcagtcgtcaacctgctccgccgcggcatcaccgcccgggacatcatgacccgggaggcattcgagaacgcgatcgctgtcgtgatggccctgggcggctccaccaacgccgtgctccatctgctcgcgatcgcccgcgaggcgaacgtcgacctcgccatcgacgatttcaaccggatcggggaccgggtcccgcacttggcggatgtcaagccgttcggccggtacgtgatgagtgacgtcgaccgggtcggcggcgtgcccgtggtgatgaaagcgctgctggacgccgggctgctgcacggcgactgcctgacggtgaccggcaagacggtggcggagaacctcgcggacatcaccccgccggaccccgacggcaaggtgattcacgcgctcacccaaccgatccaccgcaccggcgggctggccattctccgcggttcgctcgccccggacggcgcggtggtgaagaccgccgggctggagtcgacgttcttcgaaggcaccgcccgggtgttcgacggcgaggaggcggccatgcgcgccgtgcccgagctgcgtccgggagatgtcgttgtcatccggtacgaggggccgaaaggcggcccagggatgcgggagatgctcgcggtcaccggcgccatcaagggcgcgggcctcggcaaggatgtgctcctcgtcaccgacggccggttctccggcggtaccacgggtttctgtgtcgctcacgttgctccggaggcggtggacgggggaccgatcgcgttcgtccgggacggtgaccgcatccggctggacgcgcaggcccgtaccctcgacctgctggtggacgccgatgagctggccaaacgacgggccgactggcaaccgccgccgccgcggtacaccaccggagtcgcggccaagtacgtcaagctggttggcagcgcctccgagggtgcgatctgtcggtga

SEQ ID NO: 40 - protein, 558 aa, Acidothermus cellulolyticus
MRAQPDLKPRSRDVTDGLERAAARGMLRAVGMTDADWEKPQIGVASSWNEITPCNLSLDRLAQAAKEGVHAAGGYPLEFATISVSDGISMGHEGMHFSLISREVIADSVETVFMAERFDGAVLLAGCDKSEPGMLMAAARLDLAAVFLYAGSTLPGKLGDRDINIVDAFEAVGGCLRGLVSREEVDAIERNFCPVEGACAGMFTANTMASAAEALGMSLPGSASPPAPDRRRDGFARASGEAVVNLLRRGITARDIMTREAFENAIAVVMALGGSTNAVLHLLAIAREANVDLAIDDFNRIGDRVPHLADVKPFGRYVMSDVDRVGGVPVVMKALLDAGLLHGDCLTVTGKTVAENLADITPPDPDGKVIHALTQPIHRTGGLAILRGSLAPDGAVVKTAGLESTFFEGTARVFDGEEAAMRAVPELRPGDVVVIRYEGPKGGPGMREMLAVTGAIKGAGLGKDVLLVTDGRFSGGTTGFCVAHVAPEAVDGGPIAFVRDGDRIRLDAQARTLDLLVDADELAKRRADWQPPPPRYTTGVAAKYVKLVGSASEGAICR

SEQ ID NO: 41 - DNA, 1704 bp, Corynebacterium efficiens
atgaccaacgatcatgacatcgatatcaagccacgttcacgcgatgtgaccgacggcctggaacgcaccgccgcccggggcatgctccgggcagtcggcatgggcgacgacgactgggagaaaccccagatcggtgtggccagctcctggaatgaaatcaccccctgtaatctcacgctgaagaagcttgctggatttgccaaggagggtgtccacgaggcggggggttaccccctggagttcgggaccatctccgtctccgacggtatctccatgggccacgagggcatgcactattccctggtatcccgcgaggtcatcaccgactccgtggaaaccgtcatgagtgccgagcgactggacggttctgttctactcgccggctgtgacaaatccattcccggcatgctcatggccgccgcccggttgaatctgtcctcggtgttcctctacaacggatccaccatgccgggcaccgcgaagatgtccgacggtacggagcgggaggtcaccctcatcgatgccttcgaggccgtcggagcctgtcgtgcgggaaccatgagccgggaggacgtggatgccattgaacgctccgtgtgccccggggagggtgcctgtggcggcatgtacacagccaacaccatggcctcggctgctgaggccatgggcatgtccctgcccggttccgccgctcccccggcgatccaccaggaccgcaccctctatgcccgccgttccggcgaggcggtggtggaactgctgcgcaggggaatccgtgcccgtgacatcatcacacgggaatcactgctcaatgccgtcgccgtggtcatggcgctgggtggctccaccaacgcggttctgcacctcatggccatcgcccacgaggccgaggtggatctcaccttggaggacttcaacgccgtcggcgacaaggtcccccaccttggtgacctcaaacccttcggccggtatgtgatgaacgacgtattcaagatcggcggcatccccgtggtgatgaaagcgcttctcgacgccggcctcatcaacggcgactgcctcaccatcaccggccggaccgttgcggagaacctccagggcatcaacccaccggatcccgacggccagatcctacgggccattgacaacccgatccacaagaccggtgggctgaccatcctgcacggttccctcgcaccgggtggtgccgtggtcaaaaccgctggtttcgacaccgaacgcttcgagggcaccgcccgtgtcttcaaccaggaagcacccgccatggatgcggtgctcaacggtgaactgaaggctggcgacgtggtgatcatccgctacgagggaccgaagggcggccccggcatgcgcgagatgctcgccatcaccggtgccatcaagggtgccggcatcggcaaggaggtgctgctcatcaccgacggtcgtttctccggtgggtccaccggcctgtgcatcgggcatgtggcccccgaggccgtcgacggcggacctatcgccctcgttgaagacggcgatcccatcctggtcgacatcagccaacgacgtatcgatctcctggtagacgaatccattctggaggagcgcaggaaaaccctgcagcatccggagaatccacgtctccacggcgtgctggggaagtacgccaagctggtgcagtcagcctcaatgggcgcggtctgcttctag

SEQ ID NO: 42 - protein, 567 aa, Corynebacterium efficiens
MTNDHDIDIKPRSRDVTDGLERTAARGMLRAVGMGDDDWEKPQIGVASSWNEITPCNLTLKKLAGFAKEGVHEAGGYPLEFGTISVSDGISMGHEGMHYSLVSREVITDSVETVMSAERLDGSVLLAGCDKSIPGMLMAAARLNLSSVFLYNGSTMPGTAKMSDGTEREVTLIDAFEAVGACRAGTMSREDVDAIERSVCPGEGACGGMYTANTMASAAEAMGMSLPGSAAPPAIHQDRTLYARRSGEAVVELLRRGIRARDIITRESLLNAVAVVMALGGSTNAVLHLMAIAHEAEVDLTLEDFNAVGDKVPHLGDLKPFGRYVMNDVFKIGGIPVVMKALLDAGLINGDCLTITGRTVAENLQGINPPDPDGQILRAIDNPIHKTGGLTILHGSLAPGGAVVKTAGFDTERFEGTARVFNQEAPAMDAVLNGELKAGDVVIIRYEGPKGGPGMREMLAITGAIKGAGIGKEVLLITDGRFSGGSTGLCIGHVAPEAVDGGPIALVEDGDPILVDISQRRIDLLVDESILEERRKTLQHPENPRLHGVLGKYAKLVQSASMGAVCF

SEQ ID NO: 43 - DNA, 1713 bp, Brevibacterium linens
atgagcattgatacgaactccaccaaaccggacatcaaaccacgttctcgcgacgtcaccgacggtctcgaagccaccgctgcgcgcggcatgctgcgtgccgtgggaatgggcgatgacgactgggtcaagccgcagatcgccatcgcgacctcgtggaacgagatcaccccgtgcaacatgtccctgcagcgcctcggtgcggccgccaaggaaggcgtgcacgaatcgggcggattccccctggaattcggcaccatctccgtctccgacggcatctccatgggccacgagggcatgcactactcgctggtctcgcgcgaggtcatcaccgactccgttgagaccgtgatgagcgccgaacgactcgacggatcggtcctcatggccggctgcgacaagtcgatcccgggcatgctcatggcatccgcccgcctcggcctctccagcgtattcctctacaacggctcgatcatgccgggtaccgcgaagatggaggacggcaccgagaaggaagtcaccctcatcgacgccttcgaagcagtcggcgcctgccgtgccggaaccatcagccaaaaagacgtcgactccatcgagcgcgccgtctgcccgggtgaaggcgcctgtggtggcatgtacaccgcgaatacgatggcctcggccgccgaggccatgggcatgtccctgccaggctcggccgcacctcctgccatccaccgcgaccgcacgatgttcgcgcgcaaatccggtgatgctgtcgtcaacctgctgcgtcagggaatcacgacgaaggacatcatcacccgcgaatcgctgcacaacgcgatcgccgtggtcatggccttcggcggatcgaccaacgcggttctccacctcctggccatcgcccacgaggccggagtcgaactcgccctcgatgacttcaaccgcatcggcgacaaggtcccgcacctgggcaacgtcaaacccttcggccagtacgtgatgaacgatgtgttcaagatcggcggcgtgccggtgatcatgaaggctctgctcgacaacggaatgctcaacggcgactgcatgaccgtgacgggaaagaccgtggcggagaacctcgagacgatcaacccgccggaccccgacggcaagatcctgcgcgcgctcaacaacccgattcacgccaccggcggcctcaccgtgctcaagggctcgttggctcccgaaggtgcagtcgtgaagtccgccggcttcgatgccgacgtcttcgaaggcaccgctcgcgtgttcaaccaggagaagccggccatggatgccgtcctcaacggtgagctgaagaagggcgatgtcgtcgtcatccgctacgaaggacccaagggcggacccggtatgcgcgagatgctcgccatcaccggtgcgatcaagggcgcgggaatcggcaaggacgtcctgctcatcaccgacggacgcttctccggcggatcgacgggactgtgcatcggtcacgtggcgcccgaggccgtcgacggcggaccgatcgcactcgtcgaggacggcgacaagatcaccgtcgacatcgcggcacggtccatcgacctgcatgttgacgagtcggtgctcgaagagcgtcgcaagacctggacgattcccgagaaccaccgcctcaccggtgtgctcggaaagtacgcgaagctcgtgcagtcggcctccaccggtgccgtctgcttctga

SEQ ID NO: 44 - protein, 570 aa, Brevibacterium linens
MSIDTNSTKPDIKPRSRDVTDGLEATAARGMLRAVGMGDDDWVKPQIAIATSWNEITPCNMSLQRLGAAAKEGVHESGGFPLEFGTISVSDGISMGHEGMHYSLVSREVITDSVETVMSAERLDGSVLMAGCDKSIPGMLMASARLGLSSVFLYNGSIMPGTAKMEDGTEKEVTLIDAFEAVGACRAGTISQKDVDSIERAVCPGEGACGGMYTANTMASAAEAMGMSLPGSAAPPAIHRDRTMFARKSGDAVVNLLRQGITTKDIITRESLHNAIAVVMAFGGSTNAVLHLLAIAHEAGVELALDDFNRIGDKVPHLGNVKPFGQYVMNDVFKIGGVPVIMKALLDNGMLNGDCMTVTGKTVAENLETINPPDPDGKILRALNNPIHATGGLTVLKGSLAPEGAVVKSAGFDADVFEGTARVFNQEKPAMDAVLNGELKKGDVVVIRYEGPKGGPGMREMLAITGAIKGAGIGKDVLLITDGRFSGGSTGLCIGHVAPEAVDGGPIALVEDGDKITVDIAARSIDLHVDESVLEERRKTWTIPENHRLTGVLGKYAKLVQSASTGAVCF

SEQ ID NO: 45 - DNA, 1710 bp, Tropheryma whipplei
gtgtttatgtcgagcgatgcaaatgcctgtgaaatagatataaagccgagaagccgagtcgtaacccatgggatcgaggcgacaacatcgcgtggtatgctgcgcgccgttggaatgggtgatgctgattgggaaaaaccacagattggcattgcatccagttggaataacataactccgtgcaatttgtcacttgacagacttgcgcagggtgcaagggaaggtgttcacgcagccggtgggtatccgctgcagttttgcactatatcggtttccgacggaatctctatgggtcatgagggaatgcatttttctcttgtttctcgcgaagttattaccgacagcgtggaaaccgttctgatggcagaggcactggatggtgttgttcttcttgctggctgtgataaatccctcccgggtatgcttatggcagctgcaaggcttgatgtgtctgcagtatttctatatgccggcagtattgcccccggttatgtcacactcaagtgtggcgagtcaaaagaagttacaataattgattcattcgaagccgttggtgcctataaggcagggcttattgatcaggatgatcttggccggattgaaagggccatatgccccggggagggcgcatgtggcggcatgtatacggcaaacacaatggcatctgttgcagaagcgcttggtatgagtcttttgggttcggcaagtccaccctcggcagatcgtcgtcgtgatgtttatgcacataagtcgggcgaggcggttgttgagctcctgaagcggggtataaccgcaagagatattttgacaaaagaggcatttgaaaatgcgatagcagttgttatggcccttggcggatctacaaacgccgttttgcatttacttgcgatagctcatgaggcccatgtgccactgacgatagacgattttaacaaaatcgggaatagggttcctcatattgcagacctcaagccttttgggcgctatgtaatgaatgatgtagatcgcgtgggaggtattccagttgttataaatgcattgatgcgggaaggttttatacacggtgatgtaattaccgtttcaggcagaacaatggccgaggagatatctgatatcaatccgggccttcccgacggaaaggttatacactctttttcctcacctctgcacccaacaggcggtataaaggtattaaaaggtacgcttgcaccggatggggccgttgcaaaaacagctggtttcgatactgtggtttttcaaggccccgcaatggtgtttgatcgcgagcgcgcggctatggatgctctcagtgctgggaatataaaaaaggggagcgttattgttattcgctatgaaggcccaaaagggggtccgggtatgcgagagatgctggctattaccgcggcaataaagggaagtggccttggtaaagatgttttattgttgacagacggcaggttctcgggcggtacaaccggtctgtgtatagggcatattgcgccagaggcggttgatcttgggccgattgcgtttgtgcaagatggcgatataatccgcgttgatattgagaaatcgagtattgatgttctggttgatgaaaagcaattgcgcgccaggcacttgactccacccccacccaggtatacaagcggtgttctttcaaaatattcaaaactcgtcaaatctgcttctttgggtgcaataacttag

SEQ ID NO: 46 - protein, 569 aa, Tropheryma whipplei
MFMSSDANACEIDIKPRSRVVTHGIEATTSRGMLRAVGMGDADWEKPQIGIASSWNNITPCNLSLDRLAQGAREGVHAAGGYPLQFCTISVSDGISMGHEGMHFSLVSREVITDSVETVLMAEALDGVVLLAGCDKSLPGMLMAAARLDVSAVFLYAGSIAPGYVTLKCGESKEVTIIDSFEAVGAYKAGLIDQDDLGRIERAICPGEGACGGMYTANTMASVAEALGMSLLGSASPPSADRRRDVYAHKSGEAVVELLKRGITARDILTKEAFENAIAVVMALGGSTNAVLHLLAIAHEAHVPLTIDDFNKIGNRVPHIADLKPFGRYVMNDVDRVGGIPVVINALMREGFIHGDVITVSGRTMAEEISDINPGLPDGKVIHSFSSPLHPTGGIKVLKGTLAPDGAVAKTAGFDTVVFQGPAMVFDRERAAMDALSAGNIKKGSVIVIRYEGPKGGPGMREMLAITAAIKGSGLGKDVLLLTDGRFSGGTTGLCIGHIAPEAVDLGPIAFVQDGDIIRVDIEKSSIDVLVDEKQLRARHLTPPPPRYTSGVLSKYSKLVKSASLGAIT

SEQ ID NO: 47 - DNA, 1731 bp, Methylobacterium extorquens
atggacgcgcgtcagaccgacaagtcgaagctgccgagccggcacgtgacggaggggcccgagcgggcgccccaccgctcgtacctctacgccatgggcctgacgaccgagcagatccaccagccgctggtcggcgtcgcctcgtgctggaacgaggccgcgccctgcaacatctcgctgatgcgccaagcccaggccgtgaagaagggtgtcgccgccgccaagggcactccgcgcgagttctgcaccatcaccgtcaccgacggcatcgccatgggccatggcggtatgcgcgcctcgctgccttcccgcgaggtcatcgccgattcggtcgagctgacgatccgcggccattcctacgacgccctcgtggggctggccggctgcgacaagtccctgcccggcatgatgatggccatggtgcgcctcaacgtgccctcgatcttcatctatggcggctcgatcctgccgggctcgttccgcggccggccggttacggtgcaggatctgttcgaggcggtcggcaaggtcgccgtcggcgacatgagcctcgacgacctcgacgagctggagcgggttgcctgcccctcggccggcgcctgcggcgcgcagttcaccgccaacaccatggccaccgtctccgaggcgatcggcctcgcgctgccctactcggccggcgcgcctgccccttacgagatccgcgaccaattctgcgccgccgccggcgagaaggtgatggagctgatcgccaagaacatccgcccgcgcgacatcgtcacccgcaaggcgctggagaacgccgccgcgacggtcgcggcctcgggcggctcgaccaacgcggccctgcacctgccggcgatcgcgcatgaatgcggcatcgagttcaccctgttcgacgtcgccgagatcttccgcaagaccccctacatcgccgacttgaagcccggcgggcgctatgtggccaaggacatgttcgaggtcggcggcatcccgctgctgatgaagacgctgctcgaccacggctacctgcacggcgactgcctcaccgtcaccggccgcaccatcgccgagaacctcgccaaggtcgcctggaacccggatcaggacgtggtgcgcccggccgacaagcccatcaccgtcaccggcggcgtggtgggcctgcgcggcaatctcgcccccgagggcgcgatcgtgaaggtcgccggcatgccgcccgaggcccaggtcttcaccggcccggcccgcgtcttcgacggcgaggaagcctgtttcgaggcggtgcagaaccgcacctacaagcccggcgacgttctggtcatccgttacgagggcccgaagggaggccccggcatgcgcgagatgctctcgaccaccgccgccctctacggccagggcatgggcgacaaggtggccctcatcaccgacgggcgcttctccggcgcgacccgcggcttctgcgtcggccatgtcggccccgaggctgccatcggcgggccgatcggcctgctgcgcgacggcgacatcatcaccctcgatgcgatcaagggcacgctcgacgtggcgctctccgacgaggaactggcccagcgtcgcagcgaatggacgccgcggggcaatgccgcgacctccggctacctctggaaatacgcgcagtccgtcgggcctgcagtgaacggggccgtgacgcatccgggcggcgcgggggagacgaacgtctatgccgacatctag

SEQ ID NO: 48 - protein, 576 aa, Methylobacterium extorquens
MDARQTDKSKLPSRHVTEGPERAPHRSYLYAMGLTTEQIHQPLVGVASCWNEAAPCNISLMRQAQAVKKGVAAAKGTPREFCTITVTDGIAMGHGGMRASLPSREVIADSVELTIRGHSYDALVGLAGCDKSLPGMMMAMVRLNVPSIFIYGGSILPGSFRGRPVTVQDLFEAVGKVAVGDMSLDDLDELERVACPSAGACGAQFTANTMATVSEAIGLALPYSAGAPAPYEIRDQFCAAAGEKVMELIAKNIRPRDIVTRKALENAAATVAASGGSTNAALHLPAIAHECGIEFTLFDVAEIFRKTPYIADLKPGGRYVAKDMFEVGGIPLLMKTLLDHGYLHGDCLTVTGRTIAENLAKVAWNPDQDVVRPADKPITVTGGVVGLRGNLAPEGAIVKVAGMPPEAQVFTGPARVFDGEEACFEAVQNRTYKPGDVLVIRYEGPKGGPGMREMLSTTAALYGQGMGDKVALITDGRFSGATRGFCVGHVGPEAAIGGPIGLLRDGDIITLDAIKGTLDVALSDEELAQRRSEWTPRGNAATSGYLWKYAQSVGPAVNGAVTHPGGAGETNVYADI

SEQ ID NO: 49 - DNA, 1734 bp, Methylobacterium nodulans
atggacgcgcgtcacaccatcgacaagtcgaagctgccgagccgctatgtcaccgaggggccggcccgggcgccgcatcgctcgtatctctatgcgatggggctgacgcgggagcagatccaccagccgctggtgggcgtcgcctcctgctggaacgaggccgccccctgcaacatcgcgctcatgcgccaggcgcaggcggtgaagaagggcgtcgccgccgcggccggtaccccgcgggaattctgcaccatcacggtcaccgacggcatcgccatgggccaccggggcatgcgcgcctcgctgccctcccgggaggtcatcgccgattccgtcgagctcaccatgcggggccacgcctacgacgccctggtggggctcgcgggctgcgacaagtccctgcccggcatgatgatggcgatggtgcgcctgaacgtgccgtcgatcttcatctatggcggctcgatcctgcccggctccttccgcgggcggccggtcacggtccaggacctgtttgaggcggtcggcaagcactccgtcggccagatgagcgacgaggatctggacgagctggagcaggtcgcctgcccgtcggccggcgcctgcggggcgcagttcaccgccaacacgatggcgaccgtctccgaggcgatcggcctcgcgctgccctattcggccggcgcgcccgctccctacgagatccgcgacaagttctgcgcggcggccggcgagatggtgatggatctcctcgccaagaacatccgcccgcgcgacatcatcacccgcaaggcgctggagaacgccgccacggtggtcgccgcctccggcggctcgaccaatgcggcgctgcacctgccggccatcgcccacgaggcgggcatcgtcttcgacctgttcgacgtcgccgagatcttccggcgcacgccctacatcgccgacctcaagccgggcgggcgctacgtcgccaaggacctgttcgaggccggcggcatcccgctcctgatgaagaccctgctggaccacggcttcctgcacggcgactgcatcaccgtgaccggccgcaccatcgccgagaacctcgccaaggtggcctggaacccggaccaggacgtcgtgcggccggccgacaccccgatcaccccgaccggtggcgtggtcggcctcaagggcaacctcgcccccgagggcgcgatcgtgaaggtcgccggcatgccggccgaccgccaagtattcgccggcccggcccgcgtcttcgacaacgaggaagcctgtttcgaggcggtgcagaaccgccagtacaaggagggcgacgtcctcgtcatccgctacgagggcccgaagggcggccccggcatgcgcgagatgctggcgaccaccgccgccctctacggccagggcatgggcgacaaggtcgcgctcatcacggacggccgcttctcgggcgcgacccgcggcttctgcgtcggccatgtcgggcccgaggccgcaatcggcggcccgatcggccttctcaaggacggggacatcatccggctcgacgcgatccagggcatcctctcggtcgatctctccgacgaggaactggccgagcgccgcaaggcctggaccccgcgcgcgaacgaggcgacctccggctatctctggaaatacgcgcagaccgtcggcccggcggtgaccggcgccgtgacgcatccgggcggagcccaggagacgctcacctatgcggacatctga

SEQ ID NO: 50 - protein, 577 aa, Methylobacterium nodulans
MDARHTIDKSKLPSRYVTEGPARAPHRSYLYAMGLTREQIHQPLVGVASCWNEAAPCNIALMRQAQAVKKGVAAAAGTPREFCTITVTDGIAMGHRGMRASLPSREVIADSVELTMRGHAYDALVGLAGCDKSLPGMMMAMVRLNVPSIFIYGGSILPGSFRGRPVTVQDLFEAVGKHSVGQMSDEDLDELEQVACPSAGACGAQFTANTMATVSEAIGLALPYSAGAPAPYEIRDKFCAAAGEMVMDLLAKNIRPRDIITRKALENAATVVAASGGSTNAALHLPAIAHEAGIVFDLFDVAEIFRRTPYIADLKPGGRYVAKDLFEAGGIPLLMKTLLDHGFLHGDCITVTGRTIAENLAKVAWNPDQDVVRPADTPITPTGGVVGLKGNLAPEGAIVKVAGMPADRQVFAGPARVFDNEEACFEAVQNRQYKEGDVLVIRYEGPKGGPGMREMLATTAALYGQGMGDKVALITDGRFSGATRGFCVGHVGPEAAIGGPIGLLKDGDIIRLDAIQGILSVDLSDEELAERRKAWTPRANEATSGYLWKYAQTVGPAVTGAVTHPGGAQETLTYADI

SEQ ID NO: 51 - DNA, 1725 bp, Rhodopseudomonas palustris
atggacgcgaaggcgacgctcaagtcgaagctccccagccggcacgtgaccgaagggccggcgcgcgcgccccatcgctcttacctctacgccatgggcctcaccaccgagcagatccaccagccgttcgtcggggtggcgtcgtgctggaacgaggccgcgccctgcaacatttcgctgatgcggcaggctcaggcggtcaagaagggcgtcgcctccgccggcggcaccccgcgcgaattctgcaccatcaccgtgactgacggcatcgccatgggccacgagggcatgcgctcgtcgctgccgtcgcgcgaggtgatcgccgactccgtcgagctgacaatccgcggccactcctatgacgcgctggtcgggctggccggctgcgacaagtctctgcccgggatgatgatggcgatggtccggctcaacgtgccgtcgatcttcatctatggcggctcgatcctgccgggcaccttccggggccagcaggtcaccgttcaggacatgttcgaggcggtcggcaagcactcggtcggcgagatgtcggacgacgacctcgacgaaatcgagcgggtcgcctgtccgtcggccggcgcctgcggcgcgcagttcaccgccaacaccatggcgaccgtgtccgaggcgatcggcctagcgctgccgtattcggccggcgcacctgctccttacgaaatccgcgatgcgttctgcacggcggccggcgagaaggtgatggagctgatcgccgccaacatccggccgcgcgacatcgtcacccgcaaggcgctggagaatgcggccgcggtggtagcagcgtccggcggctcgaccaatgctgcgctgcacctaccagcgatcgcgcatgaatgtggtatcaagttcgatctgtttgatgtcgccgaaatcttcaaaaagacaccatatatcgcggatttgaagccaggcggccgttatgtcgccaaagacatgtatgaagttggcggcataccgctcctgatgaagaccctgctcgatcatggcttcctccacggcgactgcctgaccgtcacgggacggacgatcgccgagaatctgaaagccgtgaagtggaatccgcatcaggacgtggtgcggcaggcgaaccatccgatcaccgtgactgggggcgtcgtcgggctgaagggaaacctcgcaccagaaggtgcgatcgtgaaggtcgcgggaatgtcgaacctgaagttttccgggcctgcccgctgcttcgatcgcgaggaagacgcgttcgaggcggtgcagaagcggacctacaaggaaggcgaggtcctcgtgatccgctacgaggggccgcggggcggccccggaatgcgggaaatgctcgccaccactgcggcgctgaccggccagggcatgggcggcaagatcgcgctgatcaccgacggccggttctccggcgccacccgcggcttctgcatcggccatgtcggcccggaagcggcgctgggtggtccgatcgcgctgctgcgcgacggtgacatcatcgtcatcgacgccgaggccggaacgcttgacgtaaatttgaccgacgacgaactggccgcgcgcaagtccgaatgggcgcatcgcgcgacaaaccacacgtcgggtgcgctttggaaatatgcccagcaggtcgggcccgcagtcagcggcgctgtgactcatccgggcggggcggccgagaagcagtgctatgcggatgtttga

SEQ ID NO: 52 - protein, 574 aa, Rhodopseudomonas palustris
MDAKATLKSKLPSRHVTEGPARAPHRSYLYAMGLTTEQIHQPFVGVASCWNEAAPCNISLMRQAQAVKKGVASAGGTPREFCTITVTDGIAMGHEGMRSSLPSREVIADSVELTIRGHSYDALVGLAGCDKSLPGMMMAMVRLNVPSIFIYGGSILPGTFRGQQVTVQDMFEAVGKHSVGEMSDDDLDEIERVACPSAGACGAQFTANTMATVSEAIGLALPYSAGAPAPYEIRDAFCTAAGEKVMELIAANIRPRDIVTRKALENAAAVVAASGGSTNAALHLPAIAHECGIKFDLFDVAEIFKKTPYIADLKPGGRYVAKDMYEVGGIPLLMKTLLDHGFLHGDCLTVTGRTIAENLKAVKWNPHQDVVRQANHPITVTGGVVGLKGNLAPEGAIVKVAGMSNLKFSGPARCFDREEDAFEAVQKRTYKEGEVLVIRYEGPRGGPGMREMLATTAALTGQGMGGKIALITDGRFSGATRGFCIGHVGPEAALGGPIALLRDGDIIVIDAEAGTLDVNLTDDELAARKSEWAHRATNHTSGALWKYAQQVGPAVSGAVTHPGGAAEKQCYADV

SEQ ID NO: 53 - DNA, 1725 bp, Rhodopseudomonas palustris
gtggacgccaactccaacatcaaggcgaggttgcccagccgtcacgtgacggaaggcccggagcgtgcgccgcaccgctcctacctctatgcgatggggttgaccacgcagcagatccaccagccgttcgtcggcgtggcatcgtgctggaatgaagccgcgccctgcaacatctcgctgatgcgccaggcccaggcggtgaagaagggcgtcgccgccgcgggtggtacgccacgcgaattctgcaccatcaccgtcaccgacggcatcgccatgggccatgacggcatgcgctcgtcgctgccgtcgcgcgaatgcatcgccgactcggtcgagctgaccatccgcggccactcctacgacgcgctggtcgggcttgccggctgcgacaagtcgctgcccggaatgatgatggcgatggtccggctcaacgtgccgtcgatcttcatctatggcggctcgatcctgcccggcaccttccgcggccagcaggtcaccgtgcaggacatgttcgaggcggtcggcaagcattcggtcggcgcgatgtcggacgccgacctcgacgaaatcgaacgggtggcgtgcccctcggccggcgcctgcggcgcccagttcaccgccaacaccatggcgacggtgtcggaggcgatcggcctggcgctgccttattcggccggagcacctgcgccctatgagatccgcgacgccttctgcatgaccgccggcgagcagatcatgacgctgatcgccaagaatatccggccgcgcgacatcgtcaccttgaaggcgctgcagaacgccgcggcggtggtggcggcctccggcggctcgaccaatgcggcgctgcacctgccggcgatcgcgcatgaatgcggcatcaaattcgacctgttcgacgtcgccgaaatcttcaaaaagacaccctatgtcgcggatttgaaacccggcggccgttatgtcgccaaagacatgtacgaagttggtggcataccgcttctgatgaaaacattgctcgatcatggctacctgcacggcgactgcctgacggtcaccggccggacgattgcggaaaatttggcaaccgtgaaatggaatcccgaccaggacgtggtgcgcgcagcggataacccgatcaccgtgaccggtggggtggtcgggctgcaaggcaacctcgcccccgagggggcgatcgtgaaggtcgccgggatgtccaacttgaaattctccggcccggcgcgctgcttcgatcgcgaagaggacgccttcgaggcggtgcagcacaagacctatcgcgaaggcgaagtgatcgtgatccgctacgaagggccgcgcggcggccccggcatgcgcgagatgctgtcgaccaccgcggcgctgaccgggcagggcatgggcggcaagatcgcgctgatcaccgacggccggttctccggcgccacccgcggcttctgcatcggccatgtcggaccggaagccgcgctcggcggcccgatcgcgctgttgcaggacggcgacatcatcgagatcgacgcggtggccggcacgcttaacgtaaaattgaccgaagccgaactctccgcgcgcaagaccaattggcagccgcgtgagaccaaccattcgtcaggcgcgttgtggaagtatgcccaacaggtcggccccgcgctcggtggcgcggtgacccatccgggtggttcgcacgagaaacagtgttatgcggatgtttaa

SEQ ID NO: 54 - protein, 574 aa, Rhodopseudomonas palustris
MDANSNIKARLPSRHVTEGPERAPHRSYLYAMGLTTQQIHQPFVGVASCWNEAAPCNISLMRQAQAVKKGVAAAGGTPREFCTITVTDGIAMGHDGMRSSLPSRECIADSVELTIRGHSYDALVGLAGCDKSLPGMMMAMVRLNVPSIFIYGGSILPGTFRGQQVTVQDMFEAVGKHSVGAMSDADLDEIERVACPSAGACGAQFTANTMATVSEAIGLALPYSAGAPAPYEIRDAFCMTAGEQIMTLIAKNIRPRDIVTLKALQNAAAVVAASGGSTNAALHLPAIAHECGIKFDLFDVAEIFKKTPYVADLKPGGRYVAKDMYEVGGIPLLMKTLLDHGYLHGDCLTVTGRTIAENLATVKWNPDQDVVRAADNPITVTGGVVGLQGNLAPEGAIVKVAGMSNLKFSGPARCFDREEDAFEAVQHKTYREGEVIVIRYEGPRGGPGMREMLSTTAALTGQGMGGKIALITDGRFSGATRGFCIGHVGPEAALGGPIALLQDGDIIEIDAVAGTLNVKLTEAELSARKTNWQPRETNHSSGALWKYAQQVGPALGGAVTHPGGSHEKQCYADV

SEQ ID NO: 55 - DNA, 1725 bp, Bradyrhizobium sp.
atggacgcgaagaccgacatcaagcgcaggctgcccagccgtcatgtgacggaagggccggagcgtgcgcctcatcggtcgtatctctacgcgatgggcctgaccacggcccaaatccatcagcccttcgtcggcgtcgcctcgtgctggaacgaggccgcgccctgcaacatcgcgctgatgcggcaggcgcaagccgtgaagaagggcgtggcccacgccggcggcacgccgcgcgaattctgcaccatcaccgtgaccgacggcatcgccatgggccatgacggcatgcgctcgtcgctgccgtcgcgcgaggcgattgccgattcggtcgagctgacgattcgcggtcatgcctacgacgcgctggttggcctcgccggctgcgataaatcgctgccgggcatgatgatggcgatggtccggctcaacgtgccgtcgatcttcatttatggaggctcgatcctgcccggcaatttccgcggccagcaggtcaccgtgcaggacatgttcgaggcggtcggcaagcattcggtcggcgcgatgtcggatgaggatctcgacgagctcgagcgcgtcgcctgtccgtcggccggtgcgtgcggtgctcagttcacggccaacacgatggcgaccgtctccgaggcgatcggcctggcgctgccgtactcggctggcgcgcccgcaccttacgagatccgcgattccttctgcatgaccgccggcgagaaggtcatggagctgatatcagccaacatccggccgcgcgacatcgtgacgcgagcagcactcgagaatgccgctgcggttgtggcggcctccggcggctcgaccaacgcggccctgcatctaccagcgattgcacacgaggccggcatcaagttcgacttattcgatgtcgccgaaatcttcaaaaagacaccttatatcgcggatttgaagccgggtggccgctatgtcgccaaagacatgttcgaggctggtggcattccgctcttgatgaagacgttgctcgaccatggctatttgaacggcgactgcctcacagtcaccggccggacgatcgccgaaaacctcaaaggcgtgaagtggaatccgcaccaggacgtggtgaggccggccgaccagccgatcactgcaaccggaggtgtcgttggtttgaaaggcaatctcgcgccagagggtgcgatcgtgaaagtcgcgggcatgtcgaacttgaaattcactgggccggcccgctgcttcgatcgggaagaggatgcctttgaagccgttcagaagcggtcctatcgcgagggcgaggtcatcgtcatccgctatgagggcccgcgcggcggtcccggcatgcgggaaatgctgcagaccacggcggcgctgacggggcagggcatgggcggcaagatcgcgctcatcaccgatggccggttctcgggcgcgacgcgcggcttctgcatcggccatatcgggccggaggcggcggtcggcggaccgatcgcgctggtcgaggatggcgacatcatcgagatcgacgccgaggcgggcatcctgaacgtcaagttgagcgatgccgaactgacacaacgcaagaccaagtggacgccgcgtgaaacgcatcacacgtcaggtgcactttggaaatatgcccagcaggtgggacccgccgtggcgggggccgtcacccacccaggtggtgcgcaagagaagtattgctatgcggacatctga

SEQ ID NO: 56 - protein, 574 aa, Bradyrhizobium sp.
MDAKTDIKRRLPSRHVTEGPERAPHRSYLYAMGLTTAQIHQPFVGVASCWNEAAPCNIALMRQAQAVKKGVAHAGGTPREFCTITVTDGIAMGHDGMRSSLPSREAIADSVELTIRGHAYDALVGLAGCDKSLPGMMMAMVRLNVPSIFIYGGSILPGNFRGQQVTVQDMFEAVGKHSVGAMSDEDLDELERVACPSAGACGAQFTANTMATVSEAIGLALPYSAGAPAPYEIRDSFCMTAGEKVMELISANIRPRDIVTRAALENAAAVVAASGGSTNAALHLPAIAHEAGIKFDLFDVAEIFKKTPYIADLKPGGRYVAKDMFEAGGIPLLMKTLLDHGYLNGDCLTVTGRTIAENLKGVKWNPHQDVVRPADQPITATGGVVGLKGNLAPEGAIVKVAGMSNLKFTGPARCFDREEDAFEAVQKRSYREGEVIVIRYEGPRGGPGMREMLQTTAALTGQGMGGKIALITDGRFSGATRGFCIGHIGPEAAVGGPIALVEDGDIIEIDAEAGILNVKLSDAELTQRKTKWTPRETHHTSGALWKYAQQVGPAVAGAVTHPGGAQEKYCYADI

SEQ ID NO: 57 - DNA, 1725 bp, Bradyrhizobium japonicum
atgaacgcaaagaccaacatcaagcagaggctgccgagccgtcacgtgacggaaggccctgcgcgcgcgccccatcgctcctacttctacgccatgggtctgacgacggagcagatccaccagcccttcgtcggcgtcgcctcctgctggaacgaggccgcgccctgcaacatcgctttgatgcgccaggcgcaggcggtgaagaagggcgtcgcgcatgccggcggcacaccccgcgaattctgcaccatcaccgtgaccgacggcatcgccatgggccatgacggcatgcgctcctcgctgccgtcgcgcgaatgcatcgccgattccgtcgagctgaccgtccgcggccatgcctatgacgccctcgtcggccttgccggctgcgacaagtcgctgccgggcatgatgatggcgatggttcgcctcaacgtgccctcgatcttcatctatggcggctcgatcctgcccggcaacttccgcgggcagcaggtcaccgtgcaggacatgttcgaggccgtcggcaagcactcggtcggcgccatgtcggacgaggatctcgacgagatcgagcgcgtggcgtgcccctcggcgggtgcctgcggcgcgcagttcacggccaacaccatggcgaccgtctcggaagccatcggccttgcgctgccttactcggccggtgctccggcaccgtatgaaatccgcgacgccttctgcatgaccgcgggcgagaaggtgatggagctgatcgaccagaacatccggccgcgcgacatcgtcacccgcaaggcgctggagaatgcggccgccgtggtcgcggcctccggcggctcgaccaatgctgcgctgcacctgccggcgatcgcgcacgagtgcggcatcaagtttgacttattcgacgtcgccgaaatcttcaaaaagacaccatatgtcgcggatttgaagccgggcggccgttatgtcgccaaagacatgtttgaagtaggtggcatcccgcttctgatgaagacgctgctcgacaacggatttctccacggcgactgcattacggtcaccggtcgaacgatcgccgaaaacctcaagagcgtgaagtggaatccgcaccaggatgtggtgcacccggcagacaagccgatcaccgtcaccggtggtgtggtgggtctgaagggcaatttggcgccagaaggtgcgatcgtgaaagtcgcgggaatgtccaacctgaggtttaccggtccggcacgctgcttcgaccgggaagaggacgccttcgaggccgtccagaaccgcacataccgcgaaggcgaagtcatcgtgatccgctacgagggccccaagggcggccccggcatgcgggaaatgctccagaccaccgcggcgctgaccgggcagggcatgggcggcaagatcgcgctcatcactgacggccgcttctccggcgccacccgcggcttctgcatcggccatgtcgggccggaagccgccatcggcggcccgatcgggctgctcgaggatggcgacatcatcgagatcgacgcggtcgccggcacccttaacgtaaaattgagcgaccaggagcttgcccagcgcaagaccaaatggagcgctcgcgcgactaaccacacgacgggcgcgctctggaaatatgctcagcaggttggaccagcggtcgggggggcggtcacccatccgggcggtgcgcacgagaaacagtgctatgcggacatctag

SEQ ID NO: 58 - protein, 574 aa, Bradyrhizobium japonicum
MNAKTNIKQRLPSRHVTEGPARAPHRSYFYAMGLTTEQIHQPFVGVASCWNEAAPCNIALMRQAQAVKKGVAHAGGTPREFCTITVTDGIAMGHDGMRSSLPSRECIADSVELTVRGHAYDALVGLAGCDKSLPGMMMAMVRLNVPSIFIYGGSILPGNFRGQQVTVQDMFEAVGKHSVGAMSDEDLDEIERVACPSAGACGAQFTANTMATVSEAIGLALPYSAGAPAPYEIRDAFCMTAGEKVMELIDQNIRPRDIVTRKALENAAAVVAASGGSTNAALHLPAIAHECGIKFDLFDVAEIFKKTPYVADLKPGGRYVAKDMFEVGGIPLLMKTLLDNGFLHGDCITVTGRTIAENLKSVKWNPHQDVVHPADKPITVTGGVVGLKGNLAPEGAIVKVAGMSNLRFTGPARCFDREEDAFEAVQNRTYREGEVIVIRYEGPKGGPGMREMLQTTAALTGQGMGGKIALITDGRFSGATRGFCIGHVGPEAAIGGPIGLLEDGDIIEIDAVAGTLNVKLSDQELAQRKTKWSARATNHTTGALWKYAQQVGPAVGGAVTHPGGAHEKQCYADI

SEQ ID NO: 59 - DNA, 1725 bp, Fulvimarina pelagi
atggacgcacgcgtgatcgacaagacgaaacttccgagccgtcatgtgacggaaggaccgacccgcgcgccgcaccgctcgtatctctatgcgatgggtctctccaaggaagagatccatcagccactggtcggtgttgcctcctgctggaacgaggccgcaccctgcaatatctcgctgatgcgtcaggcgcaggtcgtaaaaaagggcgttgctgccgcacacggaacgccgcgcgaattctgcacgattaccgtcaccgacggtattgccatgggccatcagggcatgaagtcgtcgctggtctcgcgcgatctcatcgccgactcggtcgaactcaccatgcgaggccactcctacgacgcgcttgtcggtcttgccggctgcgacaagtcgctgccaggcatgatgatgtcgatggtacgcctcaacgttccctcggtcttcatctacggtggctcgattctgcccggcaccttcaagggccggcaggtgaccgtgcaggatattttcgaggcggttggccagcattccgtcggcgagatgtcggacgaggatctcgacctgatcgaacaggttgcctgcccctccgccggttcctgcggcgcccagttcacagcgaacaccatggcgacggtcgcagaggcgatcggccttgcgctgccatactcctgcggtgcgccggcgccttacgaaatccgcgaccgcttctgctacgcctcgggcgagatcgtgatggatcttctgcgccgtaacatccgtccgcgcgacatcgtcacccgcaagtcgctggagaatgcggcggccgtcgtcgcggccacgggcggctcgaccaatggcgcgctgcatctgccggcgatcgcccatgagtgtggcatcgagttcgatctcttcgacgtcgccgagatcttccgcaagacgccctacgtcgcggacctcaaaccgggtggcaaatacgtcgccaaggacatgttcgaggccggcggcattccgctcctgatgaagaccatgctggagcacggctatctccacggcgactgcatgacggtcaccggacgcacgatggccgagaacatggagaaggtcgcctggaacgcggatcaggatgtggttcgcccagccaacaatccgatcacgaagaccggcggtgttgtcggcctgaagggcaatctcgcttccgacggtgcgatcgtgaaggtcgcgggcatgaagaacctgaaattctcagggccagcgcgctgtttcgattcggaggaggattgtttcaaagcggtttcggctcgcgactataaggagggcgaggttctcgtcattcgctacgagggtccgaaaggtggccccggcatgcgcgagatgcttcagacgaccgctgcgatctacggccagggaatgggcgacaaggtcgccctcatcactgatggccgcttttccggcgccacccgcggcttctgcatcggccatgttggcccggaagcggcggtcggcggaccgatcggccttttgaaagacggcgacgtgattacgatcgacgcagtcgagggaacgctggacgttgcattgagcgaagatgaactcgccgagcgccgcaaggcttgggagccgcgcgaaaccgactatcagtcgggcgcgctctggaagtatgcccaggtggttggcacggcccgtctcggtgccgtcacccatcccggcggtgcagccgagaggcagtgctatgcggacatctaa

SEQ ID NO: 60 - protein, 574 aa, Fulvimarina pelagi
MDARVIDKTKLPSRHVTEGPTRAPHRSYLYAMGLSKEEIHQPLVGVASCWNEAAPCNISLMRQAQVVKKGVAAAHGTPREFCTITVTDGIAMGHQGMKSSLVSRDLIADSVELTMRGHSYDALVGLAGCDKSLPGMMMSMVRLNVPSVFIYGGSILPGTFKGRQVTVQDIFEAVGQHSVGEMSDEDLDLIEQVACPSAGSCGAQFTANTMATVAEAIGLALPYSCGAPAPYEIRDRFCYASGEIVMDLLRRNIRPRDIVTRKSLENAAAVVAATGGSTNGALHLPAIAHECGIEFDLFDVAEIFRKTPYVADLKPGGKYVAKDMFEAGGIPLLMKTMLEHGYLHGDCMTVTGRTMAENMEKVAWNADQDVVRPANNPITKTGGVVGLKGNLASDGAIVKVAGMKNLKFSGPARCFDSEEDCFKAVSARDYKEGEVLVIRYEGPKGGPGMREMLQTTAAIYGQGMGDKVALITDGRFSGATRGFCIGHVGPEAAVGGPIGLLKDGDVITIDAVEGTLDVALSEDELAERRKAWEPRETDYQSGALWKYAQVVGTARLGAVTHPGGAAERQCYADI

SEQ ID NO: 61 - DNA, 1815 bp, Aurantimonas sp.
ttgccgccacaaaacccgctcaccccagaggtgctgatcgggcgcggcgtcgaggcgggccatgaacagcgttgtgtacgagggggaccgatggacgcgcattcgatcgacaagaagaacctgcccagccggcatgtgaccgaggggccgtcgcgcgcgccgcaccgctcgtacctctacgccatgggtctcaccaaggaagagatccatcagccgctggtcggcgtcgcctcctgctggaacgaggccgcgccgtgcaacatctcgctgatgcgccaggcgcaggtcgtcaagaagggcgtcgcggcagcccgcggtacgccgcgcgagttctgcaccatcaccgtcaccgacggcatcgccatgggccatcagggcatgaaggcttcgctcgtctcgcgcgacctcatcgccgattcggtcgaactgaccatgcgcggccacgcctatgacgcgctggtgggtctggcaggttgcgacaagtcgcttccgggcatgatgatggcgatggttcgcctgaacgtgccgtcggtcttcatctatggcgggtcgatcctgccgggcaatttccgcggccagcaggtcaccgttcaggacatcttcgaggcggtcggcaagcattcggtcggcgagatgaacgacgccgatctcgacgagatcgagcaggtcgcctgtccgtcagccggttcctgcggcgcgcagttcaccgccaacaccatggcgaccgtcgccgaggccattggcctggcgctgccctattcctgcggtgcgccggcgccctacgagatccgcgacaagttctgctacgcctcgggcgagatcgtcatggaactcttggcccgcaacatccggccgcgcgacatcgtcacccgcaaggcgttggagaacgccgccgccgtcgtcgcggcgaccggcggatcgaccaatggcgccctgcacctgccggcgatcgcgcatgagtgcggcatcgagttcgacctgttcgacgtcgcggagatcttccgcaagacgccgtacatcgccaacctcaagccgggcggcaaatacgtcgccaaggacatgttcgaggccggcggcatcccgatgctgatgaagaccatgctggaccatggctatctgcacggcgactgcatgaccgtcaccggccgcaccattgccgagaacatggcgaaggtgacctggaacccgaaccaggacgtcatccatccggccaacacgccgatcacccagaccggcggcgtcgtcggcctgaagggtaacctcgcccaggacggcgccatcgtgaaggtcgcgggcatgaagaacctgcggttctccggcccggcgcgctgcttcgattcggaagaggaatgctacgaggccgtctccaagcgccagtacaaggaaggcgaggttctcgtcatccgctacgagggcccgcgcggcggacccggcatgcgcgagatgctgtcgaccacggcggcgctctacggccagggcatgggcgacaaggtcgcgctgatcaccgacggccggttctccggcgcgacccgcggcttctgcatcggccatgtcggtccggaagcggcgctcggcggtccgatcggcctgctgcgcgacggtgacatcatcaccatcgatgccgtcgccgggacactggacgtggacgtctcggatgacgacatgaagaagcgggccgaagactggaagccccgcgaaaccgactaccagtccggtgccatctggaaatacgcccagcaggtcggcacggcgcgcctcggcgcagtgacacatccgggcgcagcggcggaaaagcactgttatgcggacctctag

SEQ ID NO: 62 - protein, 604 aa, Aurantimonas sp.
MPPQNPLTPEVLIGRGVEAGHEQRCVRGGPMDAHSIDKKNLPSRHVTEGPSRAPHRSYLYAMGLTKEEIHQPLVGVASCWNEAAPCNISLMRQAQVVKKGVAAARGTPREFCTITVTDGIAMGHQGMKASLVSRDLIADSVELTMRGHAYDALVGLAGCDKSLPGMMMAMVRLNVPSVFIYGGSILPGNFRGQQVTVQDIFEAVGKHSVGEMNDADLDEIEQVACPSAGSCGAQFTANTMATVAEAIGLALPYSCGAPAPYEIRDKFCYASGEIVMELLARNIRPRDIVTRKALENAAAVVAATGGSTNGALHLPAIAHECGIEFDLFDVAEIFRKTPYIANLKPGGKYVAKDMFEAGGIPMLMKTMLDHGYLHGDCMTVTGRTIAENMAKVTWNPNQDVIHPANTPITQTGGVVGLKGNLAQDGAIVKVAGMKNLRFSGPARCFDSEEECYEAVSKRQYKEGEVLVIRYEGPRGGPGMREMLSTTAALYGQGMGDKVALITDGRFSGATRGFCIGHVGPEAALGGPIGLLRDGDIITIDAVAGTLDVDVSDDDMKKRAEDWKPRETDYQSGAIWKYAQQVGTARLGAVTHPGAAAEKHCYADL

SEQ ID NO: 63 - DNA, 1725 bp, Hoeflea phototrophica
atgagcgtcaaagcattcgacaagtccaagcttccaagccgctacacaacggtcggcccggcgcgggcgccgcacagatcgttcctgtatgctatggggctttcgagcgaggagattgctcagccgctcgttggcgtggcgtcgtgctggaatgaggccgcaccctgcaacatttcgctgatgcgccaggcgcaggtggtgaagaaaggcgtggcttcggcccacggcacaccgcgcgaattctgcaccatcacagtgactgatggcattgcgatgggtcaccagggcatgaaagcttccctggcgagccgcgatctgattgcagattcggtggaattgaccatgcgcggtcactgctacgatgcgatcgtgggtcttgccgggtgcgacaagtcattgccgggcatgatgatgtcgatggtgcgtctgaacgtgccctcgatcttcatctatggcggttctattttgccaggcagcttccgcggccgccagattaccattcaggacgtgttcgaggccgtggggcagcattcggttggcgatatgtcggatgaagacctgctcgaaatcgagcaggttgcctgtccgtcggcgggttcctgcggcgcgcagttcacagccaacacgatggcgactgttgccgaggcgatcggactggcgctgccctattcatgtggcgcgccggcgccttacgagatccgcgaccggttcgcttacgcggccggtgaaaaagtgatggaattgctggccaagcagatccgtccgcgcgacatcgtgacccgcaaggcgctcgaaaacgccgcggccgtcgtcgcggcttcgggcggttcgaccaacgcggcgctgcatctgccagcgattgcgcatgaatgcgggatcgagttcgatctgtttgacgtggctgagatcttcaagaagacgccctacattgccgacctcaagcccggcggcaaatatgtggccaaggacatgttcgaggctggtggcattccgctgttgatgaagaccatgcttgaacatggctatctgcacggcgattgcatgaccgtgacgggccggaccatcgccgagaacatggagaaggtctcctggaacccggagcaggatgtggtgcgcccggcggataagccgatcaccgcgaccggcggtgtggtgggcctcaagggcaatcttgcgaccgacggggcgatcgtgaaagttgccgggatggaacggctgaaattcaccggacccgcacggtgttttgattccgaggaagagtgcttcaatgcggtcacaaatcgcgactataacgaaggcgacgttcttgtgatccgctacgaggggcccaagggcggccccggtatgcgtgagatgctgtcgaccactgcggccatttatggacagggtatgggcgacaaggtggcattgatcacggatggccggttctccggtgcaacgcgcggcttctgcattggccatgtcggcccggaagcggcggaaggcgggccgatcgggctcctggaagatggcgacatcatcgagatcgatgctgttgatggtgttttgagcgtgcagctttccgatgcggaactggctgcgcgcagggaaaagtggacggcgcgcgaaaccgattatgcatcgggcgtgctgtggaaatatgcccagacggtgggggccgcgcgttacggcgccgttacccatccgggcggagcaaaagaaaagcagtgctatgcggatatctga

SEQ ID NO: 64 - protein, 574 aa, Hoeflea phototrophica
MSVKAFDKSKLPSRYTTVGPARAPHRSFLYAMGLSSEEIAQPLVGVASCWNEAAPCNISLMRQAQVVKKGVASAHGTPREFCTITVTDGIAMGHQGMKASLASRDLIADSVELTMRGHCYDAIVGLAGCDKSLPGMMMSMVRLNVPSIFIYGGSILPGSFRGRQITIQDVFEAVGQHSVGDMSDEDLLEIEQVACPSAGSCGAQFTANTMATVAEAIGLALPYSCGAPAPYEIRDRFAYAAGEKVMELLAKQIRPRDIVTRKALENAAAVVAASGGSTNAALHLPAIAHECGIEFDLFDVAEIFKKTPYIADLKPGGKYVAKDMFEAGGIPLLMKTMLEHGYLHGDCMTVTGRTIAENMEKVSWNPEQDVVRPADKPITATGGVVGLKGNLATDGAIVKVAGMERLKFTGPARCFDSEEECFNAVTNRDYNEGDVLVIRYEGPKGGPGMREMLSTTAAIYGQGMGDKVALITDGRFSGATRGFCIGHVGPEAAEGGPIGLLEDGDIIEIDAVDGVLSVQLSDAELAARREKWTARETDYASGVLWKYAQTVGAARYGAVTHPGGAKEKQCYADI

SEQ ID NO: 65 - DNA, 1761 bp, Mesorhizobium loti
atgcggcaggccgcaccgcccgcggcaaggatgagaatggacgccaaggtcatttcaaaggctaagctccctagccgccatgtgactgtcggtccggcgcgtgcgccgcaccggtcctatctctatgccatggggctttccgccgccgagatcgcgcagccgctggtcggcgtcgcctcctgctggaacgaagccgcgccctgcaacatctcgctgatgcgccaggcgcaggtggtcaagaagggtgtcgccgccgccaacggcacaccgcgcgaattctgcaccatcaccgtcaccgacggcatcgccatgggccaccagggcatgaagtcgtcgctggtgtcgcgcgaggtcatcgccgattcggtcgagctcacgatgcgtggccattgctacgatgcgctggtcggcctcgccggctgcgacaagtcgctgcccggcatgatgatggccatggtgcggctcaacgtgccgtcgatcttcatctatggcggttcgatcctgcccggcagctatcgcggccgtcagattaccgtgcaggacgtgttcgaggcggtcggccagcactccgtcggcacgatcggcgacgccgagctgctcgagatcgagcaggcggcctgtccgtcggccggctcctgcggcgcccagttcaccgccaacaccatggcaaccgtcgccgaggcgatcggtctggcgctgccctattcctgcggcgcgccggcgccttacgaaatgcgcgaccgcttcaatttcgcctccggcgaaaagatcatggagctgatcgccaaaaacatccggccgcgcgacatcatcacgctgaaggcgctggagaacgcggcgaccgtggtttccgccaccggcggttcgaccaatgcggcgctgcatctgccggcgatcgcgcatgaggcgggcatcaaattcgatctcttcgatgtcgcaaggattttcgagaagacgccctacatcgccgacctcaagcctggcggcaaatatgtcgcaaaggacatgttcgaggccggcggcattccgctgttgatgaagacgctgctcgaccacggctatctgcatggcgattgcctgacggtgactggccgcactttggccgaaaacatggagcacgttgcctggaatgaacaccaggatgtggtccgcccggccaacagaccaattacccaaaccggcggtgtcgtgggcttgaagggaaaccttgcccccgaaggcgcgatcgtgaaagtcgcgggcatgacggagttgaaattctccggcccggcgcgctgcttcgattcggaagaggaatgtttcgaggcggtgacgcaacgcaactacagggaaggcgaggttctcgtcattcgctacgaagggccgcgcggtggtcccggcatgcgcgagatgctgtcgacgacggcagcgctctacggccagggcatgggcggcaaggtggcgctgatcaccgacggccgcttctcgggcgcgacgcgcggcttctgcatcggccatgtcgggccggaagcggcggtgggcggcccgatcggcctcatccgggatggcgacgtgatttcgatcgacgccgtgaacggcacgatcgaagtggcgctgtcggatagcgaactggcggcgcgggccaagacatggaaggcgcgcacgaccgactatcagtcgggcgcgatatggaaatacgcacagacggtcgggtctgccagggatggcgcggtcacccatccgggtggtgcgaaagaaacacactgctatgcggatatctga

SEQ ID NO: 66 - protein, 586 aa, Mesorhizobium loti
MRQAAPPAARMRMDAKVISKAKLPSRHVTVGPARAPHRSYLYAMGLSAAEIAQPLVGVASCWNEAAPCNISLMRQAQVVKKGVAAANGTPREFCTITVTDGIAMGHQGMKSSLVSREVIADSVELTMRGHCYDALVGLAGCDKSLPGMMMAMVRLNVPSIFIYGGSILPGSYRGRQITVQDVFEAVGQHSVGTIGDAELLEIEQAACPSAGSCGAQFTANTMATVAEAIGLALPYSCGAPAPYEMRDRFNFASGEKIMELIAKNIRPRDIITLKALENAATVVSATGGSTNAALHLPAIAHEAGIKFDLFDVARIFEKTPYIADLKPGGKYVAKDMFEAGGIPLLMKTLLDHGYLHGDCLTVTGRTLAENMEHVAWNEHQDVVRPANRPITQTGGVVGLKGNLAPEGAIVKVAGMTELKFSGPARCFDSEEECFEAVTQRNYREGEVLVIRYEGPRGGPGMREMLSTTAALYGQGMGGKVALITDGRFSGATRGFCIGHVGPEAAVGGPIGLIRDGDVISIDAVNGTIEVALSDSELAARAKTWKARTTDYQSGAIWKYAQTVGSARDGAVTHPGGAKETHCYADI

SEQ ID NO: 67 - DNA, 1728 bp, Mesorhizobium sp.
atgatggacgctcgtgcgatatcgaaggaaaagctgcccagccgctacgttaccgtagggccggcgcgggcgccgcacaggtcttatctttacgcgatggggctctcggcggaagagatcgctcagccgctggtcggcgtggcgacgtgctggaacgaggctgcgccctgcaacatctcgctgatgcgccaggcgcaagtggtgaaaaagggcgtcgcggcagccaaaggcacgccccgcgagttcacaacgattaccgttactgatggcatcgccatgggccaccagggcatgaaggcgtcgctggcctcgcgcgaggtaatcgcggattctgtggaactcaccatgcgcggccattgctatgacgcgcttgtcggccttgcgggttgtgacaaatccctgccggggatgatgatggccatggtgcgcctcaatgtgccgtcggtcttcatctatggcggttcgatcctgcctggcacctggcgcgggcggcagatcaccgttcaagacgttttcgaggcggtcggccagcattcggttggctccatttccgacgacgagctgatggaaatcgagcaagccgcttgtccctcggccggttcctgcggcgctcaattcacggccaacaccatggcgaccgttgccgaggcgattgggctggcgcttccttattcctgcggtgcgcctgcgccttacgagatgcgcgatcgcttcaactatgccgccggcgagaaggtgatggaactggtggccaagcagatacggccgcgtgacatcgtgacccggaaggcgcttgaaaacgccgcggccgtggttgccgcgtcggggggctccaccaatgcggcattgcatttgccggccatcgctcatgaagccggaattgaattcgaccttttcgacgtcgcggaagtgttcaagagaacaccctatgtcgccgatttgaagccgggcggcaaatatgtcgccaaggacatgttcgaggcgggcggcattccgctgctcatgaagaccttgctcgaccatggctatctgcatggcgactgcatgaccgtcaccggccgcacgcttgcggagaacatggaacgcgtcgagtggaacgatgcgcaggacgtggtttatccggctgacaagccgctgagcccgacgggcggcgtcgtgggccttaaaggcaatctcgcgccggatggggcaatcgtgaaggttgcaggcatgaagaacctgcgcttctccggccccgcgcgctgcttcgattcggaagaggaatgcttcgccgcggtttccgagcgccgctataaggaaggcgaggtgctggtgatccgctacgaaggtccgaaaggcgggccgggcatgcgtgaaatgctcgccaccaccgcggccctttacgggcagggcatgggcgacaaggtggcgctgatcacggacgggcggttttcaggcgcgacccgcggcttctgtatcggtcatgtcgggccggaagcagcagtgggcgggccgatagggcttctcaatgacggcgacatcataaccatcgatgcggtggcaggcacgatcgacgtggcgctcggcgaagcggaactggccgaacgccgcgctgcctggaggccgcgcgaaagcgaatatcggtccggcgcgatctggaaatacgcgcagggcgtgggcccggcgcggtatggcgcggtgacgcatcccggcgcccagaaagaaacgcactgctatgcggatatctga

SEQ ID NO: 68 - protein, 575 aa, Mesorhizobium sp.
MMDARAISKEKLPSRYVTVGPARAPHRSYLYAMGLSAEEIAQPLVGVATCWNEAAPCNISLMRQAQVVKKGVAAAKGTPREFTTITVTDGIAMGHQGMKASLASREVIADSVELTMRGHCYDALVGLAGCDKSLPGMMMAMVRLNVPSVFIYGGSILPGTWRGRQITVQDVFEAVGQHSVGSISDDELMEIEQAACPSAGSCGAQFTANTMATVAEAIGLALPYSCGAPAPYEMRDRFNYAAGEKVMELVAKQIRPRDIVTRKALENAAAVVAASGGSTNAALHLPAIAHEAGIEFDLFDVAEVFKRTPYVADLKPGGKYVAKDMFEAGGIPLLMKTLLDHGYLHGDCMTVTGRTLAENMERVEWNDAQDVVYPADKPLSPTGGVVGLKGNLAPDGAIVKVAGMKNLRFSGPARCFDSEEECFAAVSERRYKEGEVLVIRYEGPKGGPGMREMLATTAALYGQGMGDKVALITDGRFSGATRGFCIGHVGPEAAVGGPIGLLNDGDIITIDAVAGTIDVALGEAELAERRAAWRPRESEYRSGAIWKYAQGVGPARYGAVTHPGAQKETHCYADI

SEQ ID NO: 69 - DNA, 1731 bp, Parvibaculum lavamentivorans
atggacgccaagacattcgacaaatcgaaactgccgagccgccacgtcacggtcgggccggagcgcgcgccgcaccggtcctactactatgcgatgggcctcaccgaggaagagatcaatcagcccttcgtcggcgtggcgacctgctggaacgaggcggctccctgcaacatcgcgttgatgcgtcaggcgcagtcggtgaagaagggtgtcaaggccgccgccggcacgccccgcgaattctgcaccatcacggtgacggacggcatcgccatgggccaccagggcatgaaatcctcgctcgccagccgcgacgtgatcgcggattcggtcgagctcaccatgcgcggtcattgctacgacgcgctggtcggccttgccggctgcgacaagtcgctgccgggcatgatgatgtcgatggttcgtctcaacgtcccctccgtcttcatgtatggcggctcgatcctgccgggccatttcaagggcaaggacgtcaccgtggtcgacgtcttcgaggcggtcggccagcactcggcgggcaacatggaagacgaagagctgcatgcgctcgaatgcgtcgcctgtccctccgccggcgcctgcggcggccagttcacggccaacaccatggcctgcgtttcggaagccatgggcctcgcgctgccgggttcggcgggcgcgcctgcgccttatgagagccgcgacgaatatgcggaagcctcgggccgcgccgtcatgcacctcctcgccaacaacatccggccgcgcgacatcgtcacgcgcaaggcgctcgagaatgccgccgtcatcgtcgcggcgacgggcggttcgaccaatggcgggcttcatctcccggccatcgcgcatgaagcgggcatcgatttcgacctgatggaagtcgccgaaatcttcaagaagacgccctacatcaccgacctgaagcccggcggcaattacgtcgcgaaggatcttcacgaggcgggcggcgtttcgatggtcctcaaggtgctgctcgatggcggctatctccacggcgattgcctcaccgtcaccggccagtcgctcgcagacaacctcaaggacgtgaagttcaacccggaccagaaggtcgtctatccgctgtccaatccgctctcgcccaccggcggcgttgtcgggttgcagggctcgctcgcgccggatggcgccatcgtcaaggtcgcgggcatggagaaggatcatctccgtttctccggtccggcgcgttgcttcgacagcgaagaggaatgcttcgaggcggtcgacaaacgtcagtacaaggaaggtgaggttctcgtcatccgctacgagggaccgaagggtggccccggcatgcgcgaaatgctctccaccaccgccgcgctttacggccagggcatgggcgacaaggtcgcgctcatcaccgatggccgcttctccggcggcacgcgcggtttctgcatcggccatgtcggcccggaagccgccgtcggcggccccatcgcgctgatcgaggatggcgacatcatcaccatcgacgcggagaacggcaccatcgatctcgaagtcgacgaagccgtgctcgaaaagcgccgcgcgaactggaagccccgggagaccatgtacgcctccggcgcgctgtggaaatacgcgcagctcgtcggcaccgcccgcaagggcgccgtcacccatccgggcggcaaggcggagaaacatgtctatgcggatatctga

SEQ ID NO: 70 - protein, 576 aa, Parvibaculum lavamentivorans
MDAKTFDKSKLPSRHVTVGPERAPHRSYYYAMGLTEEEINQPFVGVATCWNEAAPCNIALMRQAQSVKKGVKAAAGTPREFCTITVTDGIAMGHQGMKSSLASRDVIADSVELTMRGHCYDALVGLAGCDKSLPGMMMSMVRLNVPSVFMYGGSILPGHFKGKDVTVVDVFEAVGQHSAGNMEDEELHALECVACPSAGACGGQFTANTMACVSEAMGLALPGSAGAPAPYESRDEYAEASGRAVMHLLANNIRPRDIVTRKALENAAVIVAATGGSTNGGLHLPAIAHEAGIDFDLMEVAEIFKKTPYITDLKPGGNYVAKDLHEAGGVSMVLKVLLDGGYLHGDCLTVTGQSLADNLKDVKFNPDQKVVYPLSNPLSPTGGVVGLQGSLAPDGAIVKVAGMEKDHLRFSGPARCFDSEEECFEAVDKRQYKEGEVLVIRYEGPKGGPGMREMLSTTAALYGQGMGDKVALITDGRFSGGTRGFCIGHVGPEAAVGGPIALIEDGDIITIDAENGTIDLEVDEAVLEKRRANWKPRETMYASGALWKYAQLVGTARKGAVTHPGGKAEKHVYADI

SEQ ID NO: 71 - DNA, 1734 bp, Loktanella vestfoldensis
atgcccagcaaccgtgtcgacaaatccaaattgcccagccgccacgtgactgaaggcccgtctcgcgcgccgcaccggtcctatttttatgcgatgggcctggacgaacatgagatcgcacagccttgggtcggtgtcgccacctgctggaacgaagcagccccctgcaacatcacgctgaaccggcaggcccaagccgtcaaggtcggcgtcaagaacgccaaaggcacgccgcgcgaatttaccacaatcaccgtcaccgatggcatcgccatgggccatgaagggatgcggtcgtcactcgcatcacgcgaagcgattgccgataccgttgaactgacgatgcgcggccattgctatgacgcgctggtcggtctggccggttgcgacaaatccttgcccgggatgatgatggcgatggtgcggctgaacgtgccgtcggtgttcatctatggcggctcaatcctgccgggccggttaaacgggcaggacgtgaccgtccaagacgtgttcgaagcggtgggcaagcatcaggccggtaatatgaccgatgcggagctcgaaatccttgaacgcgtcgcctgcccctctgctggggcttgtggtggacaattcaccgccaacaccatggcctgcgtgtccgaagcaatcggtctggcgctgctcaattcctctggcgcgcctgcgccctacgaatcgcgcgatcaatatggtgtcgcttcgggcgaggccgtgatgaacctgatcgccaagaacatccgcgcgcgcgatatcgtcacgcgcaaatcactggaaaacgcggcacggatcgtggcctgcaccggcgggtccaccaatgccggtctgcacctgcctgcgatcgccgccgaggctggcattgattttgatctgtccgatgtctgcgagattttccgcgatacgccctatttcgtcgatctcaaaccgggcggcaaatatgtggccaaggatctttacgaggcaggcggcgtgcctgtcgtgctgaaagaactgcgcaaggccggtctgatccacgaagattgcatgacagcgacaggccgcgtgatcggtgaagaactggacatgatcaagggtgaggcggataaccgcgtcatctattccgtcgccaatccgatcacgaaaaccggcggtgttgtcggcctgaaaggcaaccttgcccccgaaggcgccatcgtcaaggtcgcgggcatgtccgaggaagaacagatatttaccggccctgcccgcgtgttcgaatgcgaagaagacgcgttcgaggccgtaaaagcccgccaatatgaagaaggcgaagtcatcgttatccgcaacgaaggccctgcaggcggccccggtatgcgcgaaatgctgtccaccaccgccgctttgtcgggccaaggcatgggcaaaaaggtcgcgctgatcaccgacggccgcttttcaggtgcgacacgcgggttctgcgtgggtcacgtcggcccagaggccgcgcagggcggccccatcgcgctgttgaaagacggcgacatgatcacgctgaacgcgcgcaccggcgaattgtcggtggcgctgaccgatgcagaactggccgaacggcgcaaaacctgggctggcccgcgcgaaactatctatgcctcgggagccttgtggaaatatgcacagctggtcggatcgacccgtctgggcgcattgacccatccaggtgccaagggcgaaaaacacatctatatggacctgtaa

SEQ ID NO: 72 - protein, 577 aa, Loktanella vestfoldensis
MPSNRVDKSKLPSRHVTEGPSRAPHRSYFYAMGLDEHEIAQPWVGVATCWNEAAPCNITLNRQAQAVKVGVKNAKGTPREFTTITVTDGIAMGHEGMRSSLASREAIADTVELTMRGHCYDALVGLAGCDKSLPGMMMAMVRLNVPSVFIYGGSILPGRLNGQDVTVQDVFEAVGKHQAGNMTDAELEILERVACPSAGACGGQFTANTMACVSEAIGLALLNSSGAPAPYESRDQYGVASGEAVMNLIAKNIRARDIVTRKSLENAARIVACTGGSTNAGLHLPAIAAEAGIDFDLSDVCEIFRDTPYFVDLKPGGKYVAKDLYEAGGVPVVLKELRKAGLIHEDCMTATGRVIGEELDMIKGEADNRVIYSVANPITKTGGVVGLKGNLAPEGAIVKVAGMSEEEQIFTGPARVFECEEDAFEAVKARQYEEGEVIVIRNEGPAGGPGMREMLSTTAALSGQGMGKKVALITDGRFSGATRGFCVGHVGPEAAQGGPIALLKDGDMITLNARTGELSVALTDAELAERRKTWAGPRETIYASGALWKYAQLVGSTRLGALTHPGAKGEKHIYMDL

SEQ ID NO: 73 - DNA, 1734 bp, Roseobacter sp.
atgcccaaagatcaggtcaataagacacacctgcccagccgccatgtgaccgaaggcccatcgcgcgcgccgcaccggtcgtatttttacgccatgggtctggatgaagaagcgatcaagcaaccttgggttggtgtcgcgacctgctggaacgaagcggccccttgcaacatcgccctgaaccgtcaggcgcagtcggtcaagctgggtgtgaaaaaggcgatgggcacgccgcgcgaatttacaacgattactgtcaccgacggcattgcgatggggcatgaagggatgcgctcttcgctggcgtcacgcgaagcaattaccgatacggttgagctgacgatgcgcggccactgctatgatgcgctggtcggtctggccggttgcgacaaatccctgcccggtatgatgatggcgatggtccgtctgaacgtgccgtccgtctttatctatggcgggtccattctgccgggtcgtctggatggcaaggacgtgactgttcaggacgtgttcgaggctgtgggtaaacaccaagcgggcaatatgactgatgcggaactggaagtgctggaacgtgtagcgtgtccatctgctggcgcttgcggtggtcagtttacggccaatacgatggcttgtgtgtccgaagcgattggtctggccctgatgaattcttccggtgcccctgccccttatgaaagccgcgaccagtatggcattgcatcgggtgaagcggtcatgaacctgattgaaaagaacatccgcgcccgtgatgttgtcacccgcaagtcgcttgagaacgccgcgcgcgttgtggcctgtaccggtgggtccaccaatgccggtctacacctgccggccattgcgcatgaggctggcattgatttcgacctttttgatgtctgcgacatcttccgtgatacgccttattttgtcgatctgaaaccgggtggtcaatatgtggccaaagacctttacgaggctggcggcgtacccgtcgtgctgaaagaactgcgcaaggccggtctgatccacgaggagtgcatgacagcatcaggccggaccatgggcgaagagctggatatgatcaaaggcgaggcggacaataaggtgatctattctatcgaaaacccgctgacaccaaccggtggcgttgttggtttgaagggtaatcttgcccccgaaggtgcgattgtgaaggtcgcggggatgaatacgcaagaacagtcttttacaggtcccgcccgttgctttgaaagcgaagaagatgcgtttgaggctgtgaaagcccgccaatacgaagaaggcgaagtgctggtgatccgcaatgaaggccccgccggtggccccggtatgcgcgagatgctggcgacgactgccgcactgtccggccaaggcatgggcaaaaaggtcgcgctgatcacggatggccgcttttctggtgcgacacgcgggttctgtgtgggtcatgtggggccagaggccgcgcacggtggcccgataggcctgttgcagaacggcgatgtcatcacaatcaacgctgtcactggtgaactgtcagtcgatctgagtgacgaagaactggcgacgcgcaaggcgaattggaaaggcccgaaagagacgatctatgcatccggtgctttgtggaaatacgcgcaacttgtgggtggtgcgcgtttgggtgcggtgacgcatccgggtgcgaagtctgaaaaacacatttacatggacctctga

SEQ ID NO: 74 - protein, 577 aa, Roseobacter sp.
MPKDQVNKTHLPSRHVTEGPSRAPHRSYFYAMGLDEEAIKQPWVGVATCWNEAAPCNIALNRQAQSVKLGVKKAMGTPREFTTITVTDGIAMGHEGMRSSLASREAITDTVELTMRGHCYDALVGLAGCDKSLPGMMMAMVRLNVPSVFIYGGSILPGRLDGKDVTVQDVFEAVGKHQAGNMTDAELEVLERVACPSAGACGGQFTANTMACVSEAIGLALMNSSGAPAPYESRDQYGIASGEAVMNLIEKNIRARDVVTRKSLENAARVVACTGGSTNAGLHLPAIAHEAGIDFDLFDVCDIFRDTPYFVDLKPGGQYVAKDLYEAGGVPVVLKELRKAGLIHEECMTASGRTMGEELDMIKGEADNKVIYSIENPLTPTGGVVGLKGNLAPEGAIVKVAGMNTQEQSFTGPARCFESEEDAFEAVKARQYEEGEVLVIRNEGPAGGPGMREMLATTAALSGQGMGKKVALITDGRFSGATRGFCVGHVGPEAAHGGPIGLLQNGDVITINAVTGELSVDLSDEELATRKANWKGPKETIYASGALWKYAQLVGGARLGAVTHPGAKSEKHIYMDL

SEQ ID NO: 75 - DNA, 1734 bp, Dinoroseobacter shibae
atgctcaagcgttcgttcgacaagtccaagctgcccagccgtcacgtcaccgaaggcccttcgcgcgcgccgcatcggtcctattactatgccatgggcatgaccgaggaagagatccaccagccgctggtcggggtcgccacatgctggaacgaggccgcgccctgcaacatcgcgctcagccgccaggcccaggcggtgaagatgggggtcaagcaggcctccggcacgccacgagaattcaccacgatcaccgtgaccgacgggatcgccatgggccacgagggcatgcggtcctcgctggcctcccgcgaggcgattgccgatacggtcgaattgaccatgcgcggccattgctatgacgcgattgtgggtctggcgggctgcgacaagtccctgccggggatgatgatggccatggtgcggctcaacgtgccgtcggttttcatttatggcggctcgatcctgccgggtcggttgaacggcgaggacgtgacggttcaggacgtgttcgaggccgtgggcaagcaccaggccgggaactacaccgatgcagagctggaagtgctggagcgggtggcttgtccgtccgcaggggcctgtggcggtcagttcaccgccaataccatggcctgcgtgtccgaggcgatcggtctggcgctgccgaattccgcgggcgcacccgcgccctacgagagccgcgaccagtatggcgaggcgtcgggccgcgcggtcatggacctgatcgagaaaggcatccgcgcgcgggacatcgtgacccggaagtcgctggagaatgccgcgcggatcgtggcctgcaccggcgggtcgacgaatgccggtctgcacctgcctgcgattgcccatgaggccgggatcgaattcaccttgcaggatgtctgcgacatcttccgagacacgccctatttcgtggacctcaagccgggcggcaaatacgttgccaaggacatgtacgaagcgggcggcgtgcccgtggtgatgcgcgagctgcgccgcgcgggcctgatccacgaggattgcatgaccgtgaccggctattccatcggcgaggagctcgacaaggtcacgctcgaagccgatggccgggtgatctatccggtcgacacgccgctctcgaccacgggcggggttgtcggtctcgagggtaacctggcgcccgaaggtgccatcgtgaagatcgcgggcatgagcgacgaccagttggtcttcaccggcccggcgcgcgtgttcgaatgcgaagaggacgccttcgaggcggttcagaaccgcgcttacgcggaaggcgacgtcttcgtgatccgcaacgagggtcccgcaggcggtcccggcatgcgcgagatgctggccaccacggcggcgctctcgggtcagggcatgggcaagaaggtggcgctgatcaccgatggccggttctccggggccacgcgcggcttctgcgtcggccatgtgggccccgaagcggcccatggcggccccatcgcgatgctcaaggacggcgacatgatcaccatcgacgcgctgaagggcgagctgtccgtcgcgctgagcgaggatgagcttgccgcgcgaaaagatgcctggagcggcccgcgggagacgatctatgcctcgggtgcgttgtggaaatatgcgcagctggttggcggcgcacgcctgggggcagtcacccatcccggagccaaggatgaaaaacacatctacgccgatctctga

SEQ ID NO: 76 - protein, 577 aa, Dinoroseobacter shibae
MLKRSFDKSKLPSRHVTEGPSRAPHRSYYYAMGMTEEEIHQPLVGVATCWNEAAPCNIALSRQAQAVKMGVKQASGTPREFTTITVTDGIAMGHEGMRSSLASREAIADTVELTMRGHCYDAIVGLAGCDKSLPGMMMAMVRLNVPSVFIYGGSILPGRLNGEDVTVQDVFEAVGKHQAGNYTDAELEVLERVACPSAGACGGQFTANTMACVSEAIGLALPNSAGAPAPYESRDQYGEASGRAVMDLIEKGIRARDIVTRKSLENAARIVACTGGSTNAGLHLPAIAHEAGIEFTLQDVCDIFRDTPYFVDLKPGGKYVAKDMYEAGGVPVVMRELRRAGLIHEDCMTVTGYSIGEELDKVTLEADGRVIYPVDTPLSTTGGVVGLEGNLAPEGAIVKIAGMSDDQLVFTGPARVFECEEDAFEAVQNRAYAEGDVFVIRNEGPAGGPGMREMLATTAALSGQGMGKKVALITDGRFSGATRGFCVGHVGPEAAHGGPIAMLKDGDMITIDALKGELSVALSEDELAARKDAWSGPRETIYASGALWKYAQLVGGARLGAVTHPGAKDEKHIYADL

SEQ ID NO: 77 - DNA, 1728 bp, Roseovarius nubinhibens
atgaccaaattcgacaaagcaaaattgcccagccgccatgtgaccgaaggcccggcgcgtgcgccgcaccggtcctacatgtatgcgatggggcttcaggaagaagaaatccatcagcctctggtcggcgtggcgacctgctggaacgaggcggcgccgtgcaacatttcgctcaaccggcaggcgcaatcggtcaagatgggcgtcaaggaagcgggcggcacgccgcgcgagtttaccaccatcaccgtgaccgacggcatcgccatgggccatgagggcatgcgcagctcgctcgcgtcgcgcgaggcgattgccgacactgtcgagctcaccatgcgcggccattgctatgatgcgctcgtcggtctggcgggctgtgacaagtcgctgccggggatgatgatggcgatggtgcggctcaacacgccgtcggtcttcatctatggcggctcgatcatgccgggccggttccagggccgtgacgtgaccgtgcaggacgtgttcgaggccgtcggccgccatcaggcaggggccaattcggacgaagagctgcgggcgctggaaaaggtggcctgcccgtcggccggggcctgtggcggccagttcaccgccaacaccatggcctgtgtctctgaagcgatcggtctggcgctgcccaactcggcgggcgcgcccgcgccctatgaaagccgcgatcaatatggcaccgcctctggtgcggcggtcatgacgcttttggaaaagaacatccgggcgcgcgacatcgtcacgctcaagagccttgagaatgccgcgcgggtcgtggcctgtaccggtgggtcgaccaatgccggtctgcacctgcccgcgattgcgcatgaggcggggctcgagtttttcctcgatgacgtctgccagatcttcaaggacacgccctatttcgtcgatctcaaaccgggcgggcaatatgtcgccaaggacctctatgaggcgggcggcgtgccggtggtgatgaaggagctgcgcaaggcggggctcatccacgaagattgcatgaccgtcaccgggcggaccattggcgaagagatcgacatcgtcgagcgcgaggccgatggccgggtgatctatcccgtcgagaagccgatcaccaagaccggcggcgtcgtgggcctcaagggcaatcttgccccgcagggcgccatcgtgaaggtcgcgggtatgagcgaggaagagcaagtcttctcgggccccgcgcgggtttttgaatgcgaagaggacgcctttgaggcggtcaaggcgcgcagctacaaggagggcgaggttctcgtcatccgcaacgagggccccgcaggcggtccgggcatgcgcgagatgctcgccaccacggcggcgctgtcggggcagggcatgggcaagaaggtcgcgctcatcaccgatggccggttctcgggcgcgacgcgtggcttctgcgtcggccatgtcggaccggaatcggcccatggcggcccgattgccctggtccaggatggcgatgtgatcaccatcaacgcgatcaccggcgagctcagcgtggcgctcagcgatgaggatctgacggcccgcaaggaggcctggaaaggcccgcgcgagacgatctattccagcggcgcgctgtggaaatacgcccagctcgtgggcgagacctacaagggcgctgtgacccaccccggtgccgaagcggagaagcatgtctatatggatctctaa

SEQ ID NO: 78 - protein, 575 aa, Roseovarius nubinhibens
MTKFDKAKLPSRHVTEGPARAPHRSYMYAMGLQEEEIHQPLVGVATCWNEAAPCNISLNRQAQSVKMGVKEAGGTPREFTTITVTDGIAMGHEGMRSSLASREAIADTVELTMRGHCYDALVGLAGCDKSLPGMMMAMVRLNTPSVFIYGGSIMPGRFQGRDVTVQDVFEAVGRHQAGANSDEELRALEKVACPSAGACGGQFTANTMACVSEAIGLALPNSAGAPAPYESRDQYGTASGAAVMTLLEKNIRARDIVTLKSLENAARVVACTGGSTNAGLHLPAIAHEAGLEFFLDDVCQIFKDTPYFVDLKPGGQYVAKDLYEAGGVPVVMKELRKAGLIHEDCMTVTGRTIGEEIDIVEREADGRVIYPVEKPITKTGGVVGLKGNLAPQGAIVKVAGMSEEEQVFSGPARVFECEEDAFEAVKARSYKEGEVLVIRNEGPAGGPGMREMLATTAALSGQGMGKKVALITDGRFSGATRGFCVGHVGPESAHGGPIALVQDGDVITINAITGELSVALSDEDLTARKEAWKGPRETIYSSGALWKYAQLVGETYKGAVTHPGAEAEKHVYMDL

SEQ ID NO: 79 - DNA, 1734 bp, Sagittula stellata
gtgctcaagcgtccgtttgacaagaccaaactgcccagccgtcacgtcactgagggtcccgcccgcgcgccgcatcgctccttcatgtacgccatggggttgagcgaagaagagatccatcagcctcttatcggtgtcgcgacctgctggaacgaggccgcgccctgcaacatctcgctgagccggcaggcgcaggcggtgaagctgggtgtcaaggaagcctccggcacgccgcgcgaattcaccaccatcaccgtgaccgacggcatcgcgatgggccacgaggggatgcgtgcttcgctggcctctcgcgaagccatcgccgatacggtcgagctgacgatgcgcggccactgctacgacgcgcttgtggggcttgcgggctgcgacaagtcactgcccgggatgatgatggcaatggtgcggctcaatgtgccgtcggtcttcatctatggcgggtcgatcatgccgggcaagttccagggccgcgacatcaccgttcaggacgtgttcgaggccgtgggcaagcaccaggcgggcgccaactccgacgaggaactgcgcgccatcgagaaggcggcctgtccctcggccggggcctgcggcggccagttcaccgccaacaccatggcctgcgtgtccgaggccatcggccttgcgttgttgaattcttccggcgcgccagcgccttacgaaagccgcgaccagtacggcaccgcgtccggcatcgccgtgatgaacctgctggagcgcaacatccgcgcccgcgacatcgtcacgatgaagtctctggaaaacgcggcgcgggtggtcgcctgcaccggcggttcgaccaacgccggtctgcacctgcccgccatcgcacatgaggcagggctggaattcttcctagacgacgtgtgcgagatcttccgcgacacaccctatttcgtcgacctgaagcccggcggcaactatgtggccaaggacctttacgaggtcggtggcgttccggttgtgatgaaggagctgcgcgaggcgggcctgatccacgaggactgcatcaccgcatcggggcgatcaatgggagaggaactcgacctgatcgagcgcgaggccgatggcaaagtcatctatcccatagaaacgccgatcaccaagaccggcggcgtcgtgggcctgaagggcaacctcgccccgcagggcgccatcgtgaaggtcgcgggaatcgcggcggaggaccaggtgttcaccggtcccgcgcgtgtcttcgaatgcgaggaagactgctttgaagcggtcaagatgcgcgcctacaaggagggcgaggtgctggtcatccgcaacgagggccccgcaggcggccccggcatgcgcgagatgctggctaccaccgccgccctgtccgggcagggtatgggcaagaaggttgcactgatcaccgacggccgcttttccggtgcgacgcgcggtttctgcgtgggccacgtcggcccagaggcggcgcacggcgggccgatcgcgctggtggaaaccggcgatgtcatcaccatcaacgcacagaccggagagctgtccgtggacctgacggacgagcaactggcggcccgcaaggacgcttggagcgggccgcgggacacgatctatgcctccgggtcgctgtggaaatatgcgcaactcgttggggagacatacaaaggcgccgtcacccatccaggtggcaaggcggagaaacacgtctacgccgatctctga

SEQ ID NO: 80 - protein, 577 aa, Sagittula stellata
MLKRPFDKTKLPSRHVTEGPARAPHRSFMYAMGLSEEEIHQPLIGVATCWNEAAPCNISLSRQAQAVKLGVKEASGTPREFTTITVTDGIAMGHEGMRASLASREAIADTVELTMRGHCYDALVGLAGCDKSLPGMMMAMVRLNVPSVFIYGGSIMPGKFQGRDITVQDVFEAVGKHQAGANSDEELRAIEKAACPSAGACGGQFTANTMACVSEAIGLALLNSSGAPAPYESRDQYGTASGIAVMNLLERNIRARDIVTMKSLENAARVVACTGGSTNAGLHLPAIAHEAGLEFFLDDVCEIFRDTPYFVDLKPGGNYVAKDLYEVGGVPVVMKELREAGLIHEDCITASGRSMGEELDLIEREADGKVIYPIETPITKTGGVVGLKGNLAPQGAIVKVAGIAAEDQVFTGPARVFECEEDCFEAVKMRAYKEGEVLVIRNEGPAGGPGMREMLATTAALSGQGMGKKVALITDGRFSGATRGFCVGHVGPEAAHGGPIALVETGDVITINAQTGELSVDLTDEQLAARKDAWSGPRDTIYASGSLWKYAQLVGETYKGAVTHPGGKAEKHVYADL

SEQ ID NO: 81 - DNA, 1758 bp, Roseobacter sp.
atgaccaaattcgacaaatccaaactgcccagccgttacgtgaccgaaggaccggcccgcgcgccgcatcggtcctattactatgccatgggcatgaccgaggccgagatccatcagccgctggtcggcgtggcgacctgctggaacgaggcggcgccgtgcaacatcgcgctcaaccgtcaggcgcaggccgtcaagggcggcgtcaaggaagcgcatggcagcccgcgtgaattcaccacgatcaccgtgaccgacgggatcgccatgggccatgaaggcatgcgcagctcgcttgccagccgcgaggcgattgccgacactgtcgagctgaccatgcggggccattgctatgacgcgcttgtgggtcttgcgggctgtgacaagtcgctgccgggcatgatgatggcgatggtgcggctcaatgtgccgtcagtgttcatctatggcgggtcgatcctgccgggcaaggcgcctcaggtgaacgaaatccccgaagaattccgcaaccgcgacctgacggtgcaggatatgttcgaagcggtcggctggcaccagaacgagcagatgtccgacaaggcgctcgatatgctcgaacgcgtcgcctgcccctcggcgggcgcttgcggcgggcagttcaccgccaacacaatggcctgcgtctccgaggcgatcggccttgcgctgatgaacagctcgggcatgcccgcgccctacgaatcccgcgaccaatatgccgaggcgtcgggccgcgcggtcatgacccttctggaaaagaacatccgtgcgcgggacgtggtcaccctccaaagcctgcagaacgccgcgcgcgtcgtggcctgcaccggcggctccaccaatgcgggcctgcaccttccggccatcgcccatgaggcggggatcgacttcttcctcgaagatgtctgcgagattttccgcgacacgccctatttcgtcgatctcaagcccggtggtcagtatgtggccaaggatctctatgatgcgggcgggattcccgtcgtgatgaaagagctgcgcaaggcggggctgatccacgaggattgcatcaccgcctcgggccgctccatcggcgaagagcttgacctgatcgaacgcgaggccgatggccgcgtgatctatccgatcgaaaagccgatcaccaagaccggcggtgtcgtcggcctcaagggcaatcttgcgccgcaaggcgccatcgtgaaggtcgcgggcatcgcccccgagcatcaggtcttcaccggcccggcgcgcgtgttcgaatgcgaagaggacgcgttcgaggcggtcaaggcgcgccaatacaaggaaggcgaggtcatcgtgatccgcaacgaaggccccgcaggcggccccggcatgcgcgagatgctgtccacgaccgccgcgctgtccgggcagggcatgggcaagaaggttgcgcttatcaccgatgggcgcttttcgggcgccacacgcgggttctgtgtgggccatgtcggccccgaggcggcgcatggtggcccgatcgccctgatccagaccggcgatgtggtcaccatcgacgcgatcaagggcgaactgagcgtcgatctatcggacgaggagctggccaagcgcaaggaaaactgggccggcccgcgcgagacgatctatgccaccggtgcgatctggaaattcgccaagcttgtgggcgagacctacaagggggctgtcacccatcccggcggcaaggccgagcggcatgtctacatggacctctga

SEQ ID NO: 82 - protein, 585 aa, Roseobacter sp.
MTKFDKSKLPSRYVTEGPARAPHRSYYYAMGMTEAEIHQPLVGVATCWNEAAPCNIALNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVNEIPEEFRNRDLTVQDMFEAVGWHQNEQMSDKALDMLERVACPSAGACGGQFTANTMACVSEAIGLALMNSSGMPAPYESRDQYAEASGRAVMTLLEKNIRARDVVTLQSLQNAARVVACTGGSTNAGLHLPAIAHEAGIDFFLEDVCEIFRDTPYFVDLKPGGQYVAKDLYDAGGIPVVMKELRKAGLIHEDCITASGRSIGEELDLIEREADGRVIYPIEKPITKTGGVVGLKGNLAPQGAIVKVAGIAPEHQVFTGPARVFECEEDAFEAVKARQYKEGEVIVIRNEGPAGGPGMREMLSTTAALSGQGMGKKVALITDGRFSGATRGFCVGHVGPEAAHGGPIALIQTGDVVTIDAIKGELSVDLSDEELAKRKENWAGPRETIYATGAIWKFAKLVGETYKGAVTHPGGKAERHVYMDL

SEQ ID NO: 83 - DNA, 1758 bp, Roseovarius sp.
atgaccaagttcgacaaagccaaactgcccagccgtcacgtgaccgaagggcccgagcgcgcgccgcatcggtcctattactatgccatgggcatgaccgagacggaaattcatcagccgctcgtgggcgtggcgacctgctggaacgaagcagccccctgcaacatcgcgctgaaccgtcaggcgcaggcggtcaagggtggcgtgaaagaggcgcatggcagcccgcgtgagtttaccacgatcacggtcacggacgggattgcgatggggcatgagggcatgcggtcgagccttgcgagccgggaggcaattgccgatacggtggaattgaccatgcgtggacattgctatgacgcgctggttggtttggcgggttgtgacaaatccctgcctggaatgatgatggcgatggtgcggttgaacgtgccgtccgtgttcatttatggcgggtcgatcctgccgggcaaggccccgcaggtcgaggagattccggcggatttccgcagccgtgatctgaccgtgcaggacatgttcgaggcggtggggcggcatcagaacaacgagatgtccgacaaggcgctggatatgctggagcgggtggcctgcccatcggcgggggcctgtggcgggcagttcaccgccaacaccatggcctgtgtttctgaggcgattggtctggcgttgatgaattcctcgggtatgcctgccccttatgaaagccgcgatcaatatgccgaggcgtctggtcgtgcggtgatgcatcttttggagcgcaacatccgggcgcgggacgtggtgacgctcaagtcgttgcagaatgcggcgcgggttgtggcctgcaccggtggcagcaccaatgccggtttgcacctgcctgcgattgcgcatgaggcggggattgatttctttctcgaagatgtctgcgacatcttccgcgacacgccctatttcgtcgatctgaaaccgggcggggcctatgtggccaaagacctttatgatgccggtggtatcccggttgtgatgaaggaattgcgcaaggccggtctgattcatgaggattgcatcaccgcgagcgggcgcagcatcggcgaggagctggacctgatcgagcgcgaagccgatggcaaggtcatctatccgattgaaacgccgatcaccaagacggggggcgttgtcggtctcaagggcaatctggccccgaccggcgcgattgtgaaagtggcgggcattgcgcccgagcatcaggtctttaccggcccggcgcgggtgtttgaatgtgaagaagacgcattcgaggccgtcaaagcgcgcgcctataaagagggcgaggtgatcgtcatccgcaatgaaggcccggcaggcggccccggcatgcgcgagatgctgtcgaccacagcggcgctgagcggtcagggcatgggcaagaaggtggcgctgatcaccgacgggcggttctctggggcgacacgcgggttctgtgtgggccatgttggaccagaggccgcgcatggtggcccgattgccttgattgccacgggcgacatgatcacgattgacgcgatcaagggggaattgtcggttgatctgagcgacgaggaactggccaagcgcaaggacgcttggggcgggccgcgcgagacgatctataccagcggggcgctgtggaaatatgcgcaattggtgggcgagacctataagggcgctgtgacccatcccggcgcagcgttcgagcggcatgtctatatggacctctga

SEQ ID NO: 84 - protein, 585 aa, Roseovarius sp.
MTKFDKAKLPSRHVTEGPERAPHRSYYYAMGMTETEIHQPLVGVATCWNEAAPCNIALNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVEEIPADFRSRDLTVQDMFEAVGRHQNNEMSDKALDMLERVACPSAGACGGQFTANTMACVSEAIGLALMNSSGMPAPYESRDQYAEASGRAVMHLLERNIRARDVVTLKSLQNAARVVACTGGSTNAGLHLPAIAHEAGIDFFLEDVCDIFRDTPYFVDLKPGGAYVAKDLYDAGGIPVVMKELRKAGLIHEDCITASGRSIGEELDLIEREADGKVIYPIETPITKTGGVVGLKGNLAPTGAIVKVAGIAPEHQVFTGPARVFECEEDAFEAVKARAYKEGEVIVIRNEGPAGGPGMREMLSTTAALSGQGMGKKVALITDGRFSGATRGFCVGHVGPEAAHGGPIALIATGDMITIDAIKGELSVDLSDEELAKRKDAWGGPRETIYTSGALWKYAQLVGETYKGAVTHPGAAFERHVYMDL

SEQ ID NO: 85 - DNA, 1758 bp, Oceanicola batsensis
atgacgaaattcgacaaatcccggctgcccagccgatacgtcaccgaaggacccgagcgcgcgccgcaccgctcctacctctatgccatggggatttccgaagaagagatccaccagccgctcgtcggcgtggcgacctgctggaacgaggccgcgccctgcaacatcgcgctgaaccgccaggcgcaggccgtcaagctgggcgtgaaggcgcgcgaaggcacgccgcgcgaattcaccaccatcaccgtcaccgacggcatcgccatgggccacgaggggatgcgatcctccctcgcctcgcgcgaggccatcgccgacacggtggagctgaccatgcgcggccactgctacgacgcgatcgtcggactggcgggctgcgacaagtccctgcccggcatgatgatggccatggtacgtctgaacgtgccctcggtcttcatctacggcggttcgatcctgcccggcaaggcaccgcaggtcgacgagatccccgaggacttccgcacccgcgacctgaccgtgcaggacatgttcgaagcggtcggccgtcaccagaacaaggagttgtcggacgctgcgctcgacatgctggaacgggtggcctgcccctcctccggcgcctgcggcggccagttcaccgccaataccatggcctgcgtctccgaggcgatcgggctggcgctgctcaactcctccggcatgcctgcgccctacgagagccgcgaccagtacggcgaggcctcgggccgcgcggtcatgaacctgatcgagaagaacatccgcgcccgcgatgtcgtcacccgcaagtcgctggaaaacgccgcgcgcgtcgtggcctgcaccggcggctcgaccaacgccggcctgcacctgcccgcgatcgcgcacgaggccggcatcgactttcaccttgatgacgtctgcgagatcttccgcgacacaccctatttcgtgaacctcaagccgggcggcgaccacgtggccaaggacctgttcgacgtcggcggcatcccggtggtgatgaacgaactgcgcaaggccggcctgatccacgaggactgcgtcacggcctcgggcaagaccatcggcgaggaactcgacaccgtcacccgcaaggccgacggcaaggtgatctatccgatcgagacgccgatcaccaagaccggcggcgtggtgggcctcaagggcaacctcgcccccgaaggcgccatcgtgaaggtcgcgggcatttcggccgaggatcagaagttcaccggccccgcccgggtcttcgaatgcgaggaagacgcctttgccgccgtgcagaaacgggaatacgaggaaggcgaggtcatcgtcatccgcaacgagggccccgcgggcggtcccggcatgcgcgagatgctggccaccaccgccgccctgtccggccagggcatgggcaagaaggtcgcgctgatcaccgacggccgcttttccggcgcgacgcgcggcttctgcgttggccatgtcggccccgaggcagcgcatggcggcccgatcgcgatgctcaagaacggcgacatgatcaccatcgacgccatcgagggttcgatcgaggtcgacctctccgaggccgaactcgaggcgcgcaaggccgactggacgggccctcgcgagacgatctacgcctcgggcgcgctctggaaatatgcgcagctggtcggcaagacctatctcggcgctgtcacccatcccggcggcaaggccgagaaacatatctatgccgatctctga

SEQ ID NO: 86 - protein, 585 aa, Oceanicola batsensis
MTKFDKSRLPSRYVTEGPERAPHRSYLYAMGISEEEIHQPLVGVATCWNEAAPCNIALNRQAQAVKLGVKAREGTPREFTTITVTDGIAMGHEGMRSSLASREAIADTVELTMRGHCYDAIVGLAGCDKSLPGMMMAMVRLNVPSVFIYGGSILPGKAPQVDEIPEDFRTRDLTVQDMFEAVGRHQNKELSDAALDMLERVACPSSGACGGQFTANTMACVSEAIGLALLNSSGMPAPYESRDQYGEASGRAVMNLIEKNIRARDVVTRKSLENAARVVACTGGSTNAGLHLPAIAHEAGIDFHLDDVCEIFRDTPYFVNLKPGGDHVAKDLFDVGGIPVVMNELRKAGLIHEDCVTASGKTIGEELDTVTRKADGKVIYPIETPITKTGGVVGLKGNLAPEGAIVKVAGISAEDQKFTGPARVFECEEDAFAAVQKREYEEGEVIVIRNEGPAGGPGMREMLATTAALSGQGMGKKVALITDGRFSGATRGFCVGHVGPEAAHGGPIAMLKNGDMITIDAIEGSIEVDLSEAELEARKADWTGPRETIYASGALWKYAQLVGKTYLGAVTHPGGKAEKHIYADL

SEQ ID NO: 87 - DNA, 1764 bp, Oceanicola granulosus
atgctcaagggcaagctggacaagtcgaaactgccgagccgccatgtgaccgacggtccggcccgcgcgccgcatcggtcctacctctacgcgatgggcctctcggacgaggagatcgcgcagccgctggtcggcgtcgccacctgctggaacgaggccgcgccctgcaacatcgcgctgaaccggcaggcgcagtcggtcaagctgggcgtgcgcgccgcctcgggcacgccgcgcgagttcaccacgatcaccgtcaccgacgggatcgccatgggccacgaggggatgcgctcgtcgctggcgagccgcgaggcgatcgccgacaccgtcgagctgaccatgcgcggccattgctacgacgcgctcgtcgggctcgcgggctgcgacaagtcgctgccggggatgatgatggcgatggtgcggctcaacgtgccgtcggtgttcatctacggcggctcgatcctgccgggcaaggtgccggccggcgccgacgtcccggccgacttcgccacccgcgacctgaccgtgcaggacatgttcgaggcggtcggccggcaccaggccggcgatctgtccgatgccgcgctcgacgtgctcgagcgggtcgcctgcccctccgccggggcctgcggcggccagttcaccgccaacaccatggcctgcgtctccgaggcgatcggcctggcgctgatgaactcctccggcgcgcccgcgccctacgagagccgcgaccagtacagcgtcgcctcgggcgaggcggtgatgaagcttctcgagagcaacatccgcgcccgcgacgtcgtcacccgcaagagcctcgagaacgccgcccgggtcgtcgcctgcaccggcggctcgaccaacgccggcctgcacctgccggccatcgcgcacgaggcggggatcgacttcgacctgttcgacgtctgcgacatcttccgcgacaccccctacttcgtcgacctcaagcccggcggccagtacgtggctaaggacctgttcgaggccggcggcgtgcccgtggtgatgaaggagctgcgcaaggccgggctgctgcacgaggactgcatcaccgccagcggcgagacgctcggcgaggcgctcgacaagatcaccggcgaggccgacggccgcgtcatccatcccgtcgccaccccgatcagcaagaccggcggcgtcgtcgggctgaagggcaacctcgccccggaaggtgcgatcgtgaaggttgccggcatggacgccgagcagcaggtcttcaccggcccggcgcgggtgttcgagtgcgaggaggacgccttcgaggcggtcaaggcgcgcagctacaaggaaggcgaggtcatcgtcatccgcaacgagggccccgccggcggccccggcatgcgcgagatgctggccaccaccgccgcgctctccgggcagggcatgggcaagaaggtcgcgctcatcaccgacggccgcttctcgggcgcgacgcgcggcttctgcgtcggccatgtcggccccgaggccgcccatggcgggccgatcgcgatgctcgagaatggcgacatgatcaccatcgacgccatcaagggcgagatctccgtcgcgctgaccgaggagcagttcgccgagcgcaaggccgcctggccgggcgcgcgcaagacggactacgcctcgggcgcgctgtggaagtacgcccagctcgtcggctccacccgtctcggcgcggtgacccatccgggcgcgaaggcggagacgcacgtctacatggatctctga

SEQ ID NO: 88 - protein, 587 aa, Oceanicola granulosus
MLKGKLDKSKLPSRHVTDGPARAPHRSYLYAMGLSDEEIAQPLVGVATCWNEAAPCNIALNRQAQSVKLGVRAASGTPREFTTITVTDGIAMGHEGMRSSLASREAIADTVELTMRGHCYDALVGLAGCDKSLPGMMMAMVRLNVPSVFIYGGSILPGKVPAGADVPADFATRDLTVQDMFEAVGRHQAGDLSDAALDVLERVACPSAGACGGQFTANTMACVSEAIGLALMNSSGAPAPYESRDQYSVASGEAVMKLLESNIRARDVVTRKSLENAARVVACTGGSTNAGLHLPAIAHEAGIDFDLFDVCDIFRDTPYFVDLKPGGQYVAKDLFEAGGVPVVMKELRKAGLLHEDCITASGETLGEALDKITGEADGRVIHPVATPISKTGGVVGLKGNLAPEGAIVKVAGMDAEQQVFTGPARVFECEEDAFEAVKARSYKEGEVIVIRNEGPAGGPGMREMLATTAALSGQGMGKKVALITDGRFSGATRGFCVGHVGPEAAHGGPIAMLENGDMITIDAIKGEISVALTEEQFAERKAAWPGARKTDYASGALWKYAQLVGSTRLGAVTHPGAKAETHVYMDL

SEQ ID NO: 89 - DNA, 1728 bp, Rhodobacterales bacterium
atgacgaaatttgacaaaaccaacctgcccagccgccatgtaaccgagggtcctgcgcgtgcgccgcatcgttcgtatttatatgctatggggttgtctgaagatgaaattcaccagcctctagtcggtgttgccacatgctggaacgaggcggccccctgtaatatcgccctgaaccgtcaggcgcaatctgtgaaaatgggcgtcaaacaagcgatgggtacgccacgcgaattcaccacgattaccgttacagacggtattgcgatgggtcacgaaggtatgcgttcgtctttggccagccgcgaggcaatcgctgacacggttgaattgaccatgcgcggtcattgctatgatgcgatcgttggtcttgctggttgtgacaagtcattgcccggtatgatgatggcgatgatccgtttaaacacaccgtctgtgtttgtttatggcggttcaatcttgcccggtcgttacgagggtcgcgatgttactgtacaggacgtttttgaggccgtcggccagcaccaagctggaaacctttcgtcttgcgagcttgaaaaactagaagcggttgcttgtccttctgcgggtgcttgtggtggtcagtttaccgccaacaccatggcttgtgtttccgaggcaatcggtcttgccttgccaaattccgcgggcgcaccggcaccgtatgaaagccgtgatcaattctgcgaggcatccggccgcgctgttatgaatttgatcgccaaaaacattcgtgcgcgtgacatcgtaacacgtaaatcattggaaaatgcggcacgtgttgttgcttgtactggtggttcaacgaatgcaggtcttcacttgccagccatggcgcatgaggcaggcattgatttttatctggatgacgtttgtgacatcttccgcgaaacgccttatttcgtcgatctgaaaccaggtggtaattatgtagccaaagacctttatgaggttggtggcgttcccgtaattatgcgtgaattgcgcaaagcggggttgatccacgaggattgcatgacagccactggccgcacaatgggcgaagagattgatcttgttgatcgcgaagcggacggtaaagtgatttaccccgttgatgccccgttgacgaaaactggcggcgttgttggccttaaaggtaacttggccccagaaggcgcgattgtgaaagtggcgggtatcccatcacagcaccaagtgttttccggccctgcccatgtttttgaatgtgaacaggacgcttttgaagccgtgcaaaaccgtgactacaaagaaggcgaagtattcgtcattcggaacgaaggcccatcaggtggccctggcatgcgtgaaatgttggcaacgaccgccgccctttctggtcaaggcatgggtaaaaagatcgccctgattacagatggtcgcttttctggtgcaacacgtggtttctgtgttggtcacgttggaccagaggcggctcatggtggcccgattgcgttggttgaaaatggtgacatcatcaccatcaatgcaattgaaggcgaaatttcggttaatttgactgatgatgagttggctgaacgtaagacaaactggaaaggaccacgcgaaacgatctatgcgtctggtgctttgtggaaatacagtcagcaagttggcgaagtatacaagggtgctgttacccatccaggtggcaaagccgaaaaacacgtttacatggatttgtaa

SEQ ID NO: 90 - protein, 575 aa, Rhodobacterales bacterium
MTKFDKTNLPSRHVTEGPARAPHRSYLYAMGLSEDEIHQPLVGVATCWNEAAPCNIALNRQAQSVKMGVKQAMGTPREFTTITVTDGIAMGHEGMRSSLASREAIADTVELTMRGHCYDAIVGLAGCDKSLPGMMMAMIRLNTPSVFVYGGSILPGRYEGRDVTVQDVFEAVGQHQAGNLSSCELEKLEAVACPSAGACGGQFTANTMACVSEAIGLALPNSAGAPAPYESRDQFCEASGRAVMNLIAKNIRARDIVTRKSLENAARVVACTGGSTNAGLHLPAMAHEAGIDFYLDDVCDIFRETPYFVDLKPGGNYVAKDLYEVGGVPVIMRELRKAGLIHEDCMTATGRTMGEEIDLVDREADGKVIYPVDAPLTKTGGVVGLKGNLAPEGAIVKVAGIPSQHQVFSGPAHVFECEQDAFEAVQNRDYKEGEVFVIRNEGPSGGPGMREMLATTAALSGQGMGKKIALITDGRFSGATRGFCVGHVGPEAAHGGPIALVENGDIITINAIEGEISVNLTDDELAERKTNWKGPRETIYASGALWKYSQQVGEVYKGAVTHPGGKAEKHVYMDL

SEQ ID NO: 91 - DNA, 1734 bp, Paracoccus denitrificans
atgaaaaacagccgcttcgacaagtcgtccctgcccagccgccatgtgaccgaagggccggcccgcgcgccgcatcgcagctatttctatgccatgggcatatcggaggaagaaatccattccccctgggtgggcgtcgccacctgctggaacgaggccgcgccctgcaacatcgcgctggcccgacaggcgcaatcggtcaagcagggcgtcaagaagggtggcggctgcccgcgcgaattcaccaccatcaccgtcaccgacggtattgccatgggacatgaggggatgcgctccagcctcgcctcgcgcgatgccatcgccgatacggtcgagctgaccatgcgcgggcattgctacgacgcgctggtcgggctggcgggctgcgacaagtcgctgccgggcatgatgatggccatggtgcggctgaacgtgcccagcgtcttcatctatggcggctcgatcctgccgggcaagctcaacggccgcgacgtggtggtgcaggacgtgttcgaggcggtgggccagcacgcggccggcaacatgtccgatgccgagctggagatcctggagcgcgtggcctgcccctcggccggggcctgcggcgggcaatataccgcgaacaccatggcttgcgtgtcggaagccatcgggctggcgctgatgaacagctcgggcgcgccggcgccttacgaatcgcgcgaccagtatgggctggcctcgggcgaggcggtgatggcgctgatcgaaaggaacatccgtgcccgcgacgtggtgacgcgcaaatcgctggaaaacgcggcgcgggtggtggcctgcaccggcggctcgaccaatgccgggttgcacctgcccgccatcgcgcatgaggcggggatcgaattcgacctgttcgacgtctgcgagatcttccgcgacacgccctatttcgtgaacctgcgcccgggcggcgattacgtcgccaaggacttgttcgaggccgggggcgtcccggtcgtcatgcgcgaattgcgccgcgccgggctgatccacgaggattgcctgaccgcctcgggccgcagcatgggcgaggagctggacctggtcaagcgcgaggccgacggcaaggtgatccatccggtgacggcgccgctgtccaggaccggcggcgtggtcgggctgcgcggcaacctggcgcccgacggcgccatcgtgaaggtcgcgggaatggcgcccgagcaccaggtctttaccggccccgcccgggtcttcgaatgcgaggaagaggcgttcgaggccgtcgcccgccgcgattacagcgagggctgcgtgatcgtcatccgaaacgaggggccggccggcggccccggcatgcgcgagatgctggcgaccacggcggcgctgtcggggcagggcatgggcaagaaggtggcgctgatcaccgacgggcggttctcgggcgcgacgcgcggcttctgcgtcggccatgtcggtcccgaggcggcgcatggcggccccatcgccctgctgcgcgacggcgacatgatcaccatcgacgcgatcaggggcgagatctcggtggcgctgccggacgaggaactgacgcggcgccgcgccgcatgggcgggaccgcgcaagaccgactatgcctcgggcgcgctgtggaaatacgcccagttggtcggcaaggcgcgctatggcgcggtcacccatccgggcgcggcggccgaaacccatgtctatatggatcagtga

SEQ ID NO: 92 - protein, 577 aa, Paracoccus denitrificans
MKNSRFDKSSLPSRHVTEGPARAPHRSYFYAMGISEEEIHSPWVGVATCWNEAAPCNIALARQAQSVKQGVKKGGGCPREFTTITVTDGIAMGHEGMRSSLASRDAIADTVELTMRGHCYDALVGLAGCDKSLPGMMMAMVRLNVPSVFIYGGSILPGKLNGRDVVVQDVFEAVGQHAAGNMSDAELEILERVACPSAGACGGQYTANTMACVSEAIGLALMNSSGAPAPYESRDQYGLASGEAVMALIERNIRARDVVTRKSLENAARVVACTGGSTNAGLHLPAIAHEAGIEFDLFDVCEIFRDTPYFVNLRPGGDYVAKDLFEAGGVPVVMRELRRAGLIHEDCLTASGRSMGEELDLVKREADGKVIHPVTAPLSRTGGVVGLRGNLAPDGAIVKVAGMAPEHQVFTGPARVFECEEEAFEAVARRDYSEGCVIVIRNEGPAGGPGMREMLATTAALSGQGMGKKVALITDGRFSGATRGFCVGHVGPEAAHGGPIALLRDGDMITIDAIRGEISVALPDEELTRRRAAWAGPRKTDYASGALWKYAQLVGKARYGAVTHPGAAAETHVYMDQ

SEQ ID NO: 93 - DNA, 1767 bp, Oceanibulbus indolifex
atgtccaccaccccacgcttcgacaaatcccggctgcccagccgccacgtgaccgaaggcccggcccgcgcgccgcatcggtcttactactatgccatgggcatgaccgagcaagagattcaccagccgctggtgggcgtcgccacctgctggaacgaagcagcgccctgcaacatcgcgctgagccgtcaggcgcaggccgtgaagatcggtgtgcattccgaacagggcacgccgcgcgagtttaccacgatcaccgtcaccgatggtatcgcgatgggccacgagggcatgcgctcctcgctcgcgtcgcgcgaagcgattgccgacacggttgagctgaccatgcgcggccactgctatgacgccatcgtgggcctcgcgggctgcgacaaatctctgccggggatgatgatggcgatgctgcggttgaacgtgccgtcggtcttcctctatggcgggtcaatcctgccgggcaaagcacctgccggggccgatgtgcccgaggatttcgccagccgcgatctgaccgtgcaggacatgttcgaagcggtgggccggttccagaacggcaccatgtcgcaagcagccctcgacgtgcttgagcgcgtggcttgcccatcggcgggcgcttgtggcggccagttcaccgccaatacaatggcctgcgtctccgaggcgatcggcctcgcgctgcccaactcgtccggcatgcccgcgccctatgagagccgcgacgcctatgccgaggcctctggcgcggcggtgatgaacctgatcgaaaagaacatccgcgcccgcgacatctgcacccgcgaagcctttgaaaacgcagcgcgcatcgtggcctgcaccggcggctcgaccaacgcgggcctgcacctgcccgccatggcgcatgaagccgggatcgagttctacctcgaagacgtttgcgaaatcttccgcgacacaccctatttcgtcgatatgaaaccgggcggcgcttatgtggccaaagatctttacgatgcgggcggcgtgccggtggtgatgaatgagttgcgcaaagcgggcctcattcacgaagactgcatgactgccaccggctactccatgggcgaagtgctcgatcaggttacccgcgaagcagacggcaaggtgatccactcggtcgccaatccgatcagcaagaccggcggtgtcgtgggcctcaaaggcaacctcgcccccgaaggtgccatcgtgaaaatcgcgggcatgtctgacgaagacatcgtcttcaccggcccggcactggtgttcgaatgtgagcaagacgctttcgaagccgtgcaaaaccgcgcctattccgaaggcgacgttttcgtcatccgcaacgaaggccccgcaggcggccccggcatgcgcgagatgctggccaccaccgccgcgctttcgggtcaaggcatgggcaagaaggtggcgctgatcaccgatggccgcttctcgggtgcgacacgtggcttctgtgtgggtcacgttggccccgaagcggcgcatggcggaccgattgcgctgctgaaaaacggcgacatgatcacccttgatgcgatcaaaggttccatcagcgtcgacctgagcgatgatgagcttgccgagcgccgcaagggctgggctggcccgcgtgccacaaactaccaaagcggcgcgctgtggaaatacgccaaacttgtcggccctacctaccttggtgccgtgacacatccgggcgctcaggccgagacccatgattacatggacctctaa

SEQ ID NO: 94 - protein, 588 aa, Oceanibulbus indolifex
MSTTPRFDKSRLPSRHVTEGPARAPHRSYYYAMGMTEQEIHQPLVGVATCWNEAAPCNIALSRQAQAVKIGVHSEQGTPREFTTITVTDGIAMGHEGMRSSLASREAIADTVELTMRGHCYDAIVGLAGCDKSLPGMMMAMLRLNVPSVFLYGGSILPGKAPAGADVPEDFASRDLTVQDMFEAVGRFQNGTMSQAALDVLERVACPSAGACGGQFTANTMACVSEAIGLALPNSSGMPAPYESRDAYAEASGAAVMNLIEKNIRARDICTREAFENAARIVACTGGSTNAGLHLPAMAHEAGIEFYLEDVCEIFRDTPYFVDMKPGGAYVAKDLYDAGGVPVVMNELRKAGLIHEDCMTATGYSMGEVLDQVTREADGKVIHSVANPISKTGGVVGLKGNLAPEGAIVKIAGMSDEDIVFTGPALVFECEQDAFEAVQNRAYSEGDVFVIRNEGPAGGPGMREMLATTAALSGQGMGKKVALITDGRFSGATRGFCVGHVGPEAAHGGPIALLKNGDMITLDAIKGSISVDLSDDELAERRKGWAGPRATNYQSGALWKYAKLVGPTYLGAVTHPGAQAETHDYMDL

SEQ ID NO: 95 - DNA, 1767 bp, Sulfitobacter sp.
atgtccaccaacacccgctttgataaatccagactgccaagccggcacgtgaccgaggggccagagcgcgcaccgcaccggtcctattactacgcaatgggcatgaccgaagaagagattcaccagcctctggtgggtgtggcaacctgctggaacgaagcggccccctgtaacatcgcgctgaaccgtcaggcccaagcggtcaaggtcggcgtcaaggcgcagcaaggcacgccacgcgaattcaccaccatcactgtcaccgacgggatcgccatgggccacgagggcatgcgctcttccctagcgtcgcgcgaagcgattgccgacacggtagagctgacaatgcgcggtcactgctacgatgcgattgtcggtcttgcgggctgtgacaaatcgctgccgggcatgatgatggcgatgctgcggctgaacgtgccgtccgtgttcctctacggtgggtcgatcctgccgggcaaagtcccggaaggggccgatgtgcctgccgatttcgccagccgcgatctgactgtgcaagacgttttcgaagccgtgggtaactaccagaacggcagcatgtcgcaagccgcgcttgaagtattggagcgcgtcgcttgcccgacagccggtgcctgcgggggccagttcaccgccaacactatggcctgcgtgtccgaggcaattggtctggcgctgctgaactcctctggcatgcctgcgccctatgaatcccgcgacgcctatgcggcggcctcgggtgaagccgtcatgaacctgatcgaaaagaacatccgcgcgcgcgacatctgcacccgcgaagcgttcgagaatgcggcgcgtatcgtggcctgcaccggcgggtcgaccaatgccggtctgcacctgcccgctatggccgccgaggcgggtatcgactttaacctcagcgatgtgtgcgacatcttccgcgacacgccttatttcgtcgacatgaaacccggcgggtcgcatgtggcaaaagacctgtatgacgcgggcggcgtgcctgttgtgatgaaagaactgcgcaaggctggcctgctgcatgatgactgtctcaccgcctcgggcctgtccatcggtgaagagctcgacaagatcgaacgcgaagccgacggcaaggtgatccacgcgatcgaaacaccgatcagcaagaccggcggcgtcgttggtctgaagggcaacttggcacccgaaggggccatcgtgaaaatcgcgggcatgtccgaagaagacatcgtctttaccggtccggcgctgatctttgaatgtgaacaggatgcgttcgaagccgtgcaaaaccgggcctacagcgaaggcgacgtgttcgtgatccgcaacgaaggccccgctggtggccccggcatgcgcgaaatgctggcgaccacggcggccctgtccggtcaaggcatgggcaaaaaggtggcactgatcaccgacggccgtttctccggcgcgacacggggtttctgcgttggtcacgtcggccccgaagccgcacatggcggaccgattgccttgctcaaacagggtgacatgatcacactgaacgcgatcaccggttcgatctctgtcgatatctcggacgaggaaatggcagaacgcaaagcggcttggcccggtgcccgcaaaacaaactatcaaagcggtgcactgtggaaatacgcgcagcttgtgggcccaacctatcttggtgcggtgacgcatcccggcgcgaaggcggaaacacatgactatatggacctgtaa

SEQ ID NO: 96 - protein, 588 aa, Sulfitobacter sp.
MSTNTRFDKSRLPSRHVTEGPERAPHRSYYYAMGMTEEEIHQPLVGVATCWNEAAPCNIALNRQAQAVKVGVKAQQGTPREFTTITVTDGIAMGHEGMRSSLASREAIADTVELTMRGHCYDAIVGLAGCDKSLPGMMMAMLRLNVPSVFLYGGSILPGKVPEGADVPADFASRDLTVQDVFEAVGNYQNGSMSQAALEVLERVACPTAGACGGQFTANTMACVSEAIGLALLNSSGMPAPYESRDAYAAASGEAVMNLIEKNIRARDICTREAFENAARIVACTGGSTNAGLHLPAMAAEAGIDFNLSDVCDIFRDTPYFVDMKPGGSHVAKDLYDAGGVPVVMKELRKAGLLHDDCLTASGLSIGEELDKIEREADGKVIHAIETPISKTGGVVGLKGNLAPEGAIVKIAGMSEEDIVFTGPALIFECEQDAFEAVQNRAYSEGDVFVIRNEGPAGGPGMREMLATTAALSGQGMGKKVALITDGRFSGATRGFCVGHVGPEAAHGGPIALLKQGDMITLNAITGSISVDISDEEMAERKAAWPGARKTNYQSGALWKYAQLVGPTYLGAVTHPGAKAETHDYMDL

SEQ ID NO: 97 - DNA, 1764 bp, Roseobacter denitrificans
atgtccagccagcgctttgataaatccaagctgcccagccgccatgtgaccgagggaccctcacgggcgccgcatcggtcctactattacgcgatgggcatgacggaggaagaaatccatcaaccgcttgttggcgtggccacttgctggaacgaggccgccccctgcaacatcgcgctgaaccgccaggcgcaatcggtcaagatgggcgtgaaacgcgaaagcggcacgccacgtgaattcaccaccatcaccgtcaccgacggcatcgcgatgggccacgagggcatgcggtcgtcactggcgtcacgcgaggcaattgccgatacggtggaactgaccatgcgcgggcattgctatgacgcacttgtggggctggcgggctgcgacaaatccctgccgggcatgatgatggcgatgatccgtctgaatgtgccatcggttttcctttatggcgggtcaatcctgccgggacgtgcgcccaagggggcgtcggtgcctgccgaatacgccgaccgcgacctgaccgttcaggacatgttcgaagctgttgggcatcaacagaacggcaccctgagcgaggcagaactcgaagtgctcgaacgcgtcgcctgcccttctgccggggcttgtggcgggcagtttaccgccaacaccatggcctgtgtatccgaggccatcggtctggcgttgcccaattccgccggggcacctgcgccgtacgaatcccgcgacgcctatgccgaagcctcgggtgcggcggtcatgaacctgatcgaaaagaacatccgtgcgcgcgacatctgcacgcgggaggccttcgagaatgccgcgcgcatcgtcgcttgtacgggcgggtcgaccaacgccggtctgcacctgcctgccatggcgcatgaagcgggcatcgatttcttcctcgaagacgtctgcgagatcttccgcgacacgccctatttcgtcgatctgaaaccgggcgggcagtatgtcgccaaggacatgtacgaagccggcggcgtgcccgtggtaatgaaagagctgcgcaaggcaggcctgttgcacgaggactgcatgaccgtcaccggctattccatcggcgaggaactggacaaggtcagccttgaggcggatggccgagttgtctatccgattgaaacaccgctgtcgaaaaccggtggcgtcgtcggcctcaagggcaaccttgcccccgaaggagccatcgtgaaaatcgccggaatggagccgcagcatttgctgttcaccggccctgcgcgaatctttgagtgtgagcaggacgcgtttgaagccgtccagaaccgcacctacaaagagggcgatgtctttgtcatccgcaacgagggccctgctggcggccccggcatgcgcgagatgctggcaacgacggcggcgctttcgggtcagggcatgggcaagaaagtcgcgctgatcacggatggacgtttctcgggggcgacacgcgggttctgcgtcggccatgtgggtcccgaggccgcgcacggaggccccatcgccttgctcaaggatggcgatatgatcacgcttaacgcgatcgaggggaccatcaccgtcgatgtgtccgacgaggagatggccgagcgtaaagccaattggaaaggggcgcgtccaacgatctatggtgctggtgccttgtggaaatacgcgcaacttgtggggccaacctatctcggggccgtgacccatccgggcggtaaagacgaaggccacgcgtacatggaactgtaa

SEQ ID NO: 98 - protein, 587 aa, Roseobacter denitrificans
MSSQRFDKSKLPSRHVTEGPSRAPHRSYYYAMGMTEEEIHQPLVGVATCWNEAAPCNIALNRQAQSVKMGVKRESGTPREFTTITVTDGIAMGHEGMRSSLASREAIADTVELTMRGHCYDALVGLAGCDKSLPGMMMAMIRLNVPSVFLYGGSILPGRAPKGASVPAEYADRDLTVQDMFEAVGHQQNGTLSEAELEVLERVACPSAGACGGQFTANTMACVSEAIGLALPNSAGAPAPYESRDAYAEASGAAVMNLIEKNIRARDICTREAFENAARIVACTGGSTNAGLHLPAMAHEAGIDFFLEDVCEIFRDTPYFVDLKPGGQYVAKDMYEAGGVPVVMKELRKAGLLHEDCMTVTGYSIGEELDKVSLEADGRVVYPIETPLSKTGGVVGLKGNLAPEGAIVKIAGMEPQHLLFTGPARIFECEQDAFEAVQNRTYKEGDVFVIRNEGPAGGPGMREMLATTAALSGQGMGKKVALITDGRFSGATRGFCVGHVGPEAAHGGPIALLKDGDMITLNAIEGTITVDVSDEEMAERKANWKGARPTIYGAGALWKYAQLVGPTYLGAVTHPGGKDEGHAYMEL

SEQ ID NO: 99 - DNA, 1764 bp, Jannaschia sp.
atgaccgccaacaggccagacaaatccagattgcccagtcgccatgtgaccgaaggacccgagcgcgcgccgcatcggtcgtatttctacgccatggacctgacacaggagcagatcgaccagccattcgtcggcgtcgccacctgctggaacgaagcggccccttgcaacatcgcgctcaactggcaggcgcaatcggtgaaacgcggtgtgggtgaggcgaacggtacgccgagggaattcaccacgatcaccgtcaccgacggcattgcgatggggcatgaagggatgcggtcctcgctggcgtcgcgcgatgcgatcaccgacacggtggaactgacgatgcgcggccactgctatgacgcattggtcgggcttgccgggtgcgacaagtccctgcccggcatgatgatggccatggtgcgcctgaacgtgccgtccgtcttcatctatggcggcacgatccttcccggcaaagcgcctgaagttgccgacattcccgccgagtttgccaaccgtgacctgaccgtgcaggacatgttcgaggccgtgggcaagtaccagtccggccaattgagcgaagccgccctggaagttctggaacgcgttgcctgcccgtctgcgggcgcctgtggcggtcagttcaccgccaacaccatggcatgtgtgtccgaggcgattggtctggcaatgctcaactcctccgggatgcctgcgccttacgaggggcggaaggaattcggcgaggcaagcggtcgcgcggtgatgaacctgcttgaaaagaacatccgcgcccgtgacgtcgtcacccgcaaagcgttggagaatgcggcccgtgttgtggcgtgtaccgggggctccaccaatgcaggtctgcaccttcccgcgattgcccatgaggccggaatcgacttcgacctctttgacgtctgcgacatcttcaaggacacgccctacttcgtcgacatgaaacccggcggtcagtatgtggcgaaagacctctatgaggtgggcggcgtgccagtcgtgatgaaggagctgttgaaagaggggctgttgcacggcgattgcctcactgcctctggcgagacgatggaagaggcgctcgacaagatccagggcacgcccgatggccgtgtggtccatacggtccagaacccgatcaccagcaccggcggcgtggtcggcctgcgcggcaatctcgccgaagagggtgcgatcgtgaaagttgcgggcatggatgaggcaagccaggtcttcaccggacccgcgcgcgtgtttgaatgcgaagaagacgcctttgccgccgtgaaggcgcgcggctacgaggaaggcgaagtcattgtcatccgcaatgaagggccaaagggcggcccgggcatgcgggaaatgttggcgacgacggcggcattgtcgggtcagggcatgggcaagaaggtggccctgatcaccgacggccggttctctggtgcaacgcggggcttctgcgtcggtcacgtgggacctgaggcggctgttggcggaccgattggtctgctggagaacagcgacatgatcaccatcaatgcgctgacgggggaactgtcggttgccttgaccgaggcggaattggccgagcgtcggaaggcctgggccggtccgcgtgagacaatgtacgcctctggcgcgttgtggaaatacgcgcaattggtgggagaggcgcgctatggcgcggtgacccatcccggcggggccaaggaaaagcacgtctatgcggacatctag

SEQ ID NO: 100 - protein, 587 aa, Jannaschia sp.
MTANRPDKSRLPSRHVTEGPERAPHRSYFYAMDLTQEQIDQPFVGVATCWNEAAPCNIALNWQAQSVKRGVGEANGTPREFTTITVTDGIAMGHEGMRSSLASRDAITDTVELTMRGHCYDALVGLAGCDKSLPGMMMAMVRLNVPSVFIYGGTILPGKAPEVADIPAEFANRDLTVQDMFEAVGKYQSGQLSEAALEVLERVACPSAGACGGQFTANTMACVSEAIGLAMLNSSGMPAPYEGRKEFGEASGRAVMNLLEKNIRARDVVTRKALENAARVVACTGGSTNAGLHLPAIAHEAGIDFDLFDVCDIFKDTPYFVDMKPGGQYVAKDLYEVGGVPVVMKELLKEGLLHGDCLTASGETMEEALDKIQGTPDGRVVHTVQNPITSTGGVVGLRGNLAEEGAIVKVAGMDEASQVFTGPARVFECEEDAFAAVKARGYEEGEVIVIRNEGPKGGPGMREMLATTAALSGQGMGKKVALITDGRFSGATRGFCVGHVGPEAAVGGPIGLLENSDMITINALTGELSVALTEAELAERRKAWAGPRETMYASGALWKYAQLVGEARYGAVTHPGGAKEKHVYADI

SEQ ID NO: 101 - DNA, 1731 bp, Caulobacter sp.
atgaccaagaaacccgacgggacctgggacaagtcgcaactgcccagccggcatgtaaccgaagggccggcccgcgcgccgcaccgctcttattattacgccatgggtcttggcacgcgtgagatcgcccagccgttcgtcggcgtcgcctcgtgctggaacgaggccgcgccctgcaacaccgccctgatgcgccaggccaacgccgtggccaagggcgtcaaggcggccggcggcaccccgcgcgagttctgcaccatcaccgtcaccgacggcatcgccatgggccacgagggcatgcgttcgtccctggtcagccgcgacgtgatcgccgactccgtcgagctgaccatgcgcggccacggctatgacgcgctcgtgggcgtcgccgggtgcgacaagagcctgccgggcatgatgatggccatgctgcgcctcaacgtgcccagcgtgttcctgtacggcggctcgatcctcccgggacgcttccagggccgcgacatcaccgtgatggacgtcttcgagggcgtcggcgcctatgccgccgggaccatggacgccaagaccctgtgcgagctggagcagcacgcctgcccgtcggacggcgcctgcggcggccagttcacggccaacaccatggcctgcgtgtcggaagccatcggcctggccctgccgctgtcctcggccctgccggccccgtacctggaccgcgaccagtacgcggtggcctcgggcgaggcggtgatgcggctgatcgagcagaacatccgcccgcgcgatatctgcacccgcaaggccttcgagaacgccgccgtcgtcgtcgcggccaccggcggttcgaccaatggcgcgctgcacctgccggccatggcccacgagtgcggcatcgagttcaccctcaaggacgtggccgagatcgccgcccgcacgccctatatcgccgacctcaagcccggcggtcgctacgtggccaaggacatgggcgaggccggcggcgtgccgatgctgctgcgcaccctgctggacgccggcctgctgcacggcgacgtcatgaccgtcaccggcaagaccctggccgagaacctggccgatgtggtctggcgtgaggaccaggacgtgatccgcccggtctccaatccgctgtcgccgactggcggcgtggtcggcctgtggggctcgctggcgcccgagggcggcatcgtcaaggtggccggcctcaagcaccaggtgcaccgcggcccggcccgggtgttcgacggcgaggcggcctgtttcgaagcggtgtcgaaccgcgactacaaggcaggcgacgtcctggtcatccgctacgaaggtccgcgcggcgggccgggcatgcgcgagatgctgtcgacgaccgccgcgatctacggccagggcgtggagaacatcgccctgatcaccgacggccgcttctcgggcgccacgcgcggcctgtgcatcggccacgtgggtcccgaggccgccgtgggcggtccgatcgccctggtgcaggacggcgacatcatcagcatcgacgccaccaaggggacgatcgagcttgaggtcgaggccgaggaactggcgcgccgcaaggccgcctggaagccgcgcggccacgactacaacagcggcgcgatctggaagttcgcccaactggtcggtccagcctatcttggcgccacgacccatccgggcgcggccaaggagacgcacgtctacgcggacatctga

SEQ ID NO: 102 - protein, 576 aa, Caulobacter sp.
MTKKPDGTWDKSQLPSRHVTEGPARAPHRSYYYAMGLGTREIAQPFVGVASCWNEAAPCNTALMRQANAVAKGVKAAGGTPREFCTITVTDGIAMGHEGMRSSLVSRDVIADSVELTMRGHGYDALVGVAGCDKSLPGMMMAMLRLNVPSVFLYGGSILPGRFQGRDITVMDVFEGVGAYAAGTMDAKTLCELEQHACPSDGACGGQFTANTMACVSEAIGLALPLSSALPAPYLDRDQYAVASGEAVMRLIEQNIRPRDICTRKAFENAAVVVAATGGSTNGALHLPAMAHECGIEFTLKDVAEIAARTPYIADLKPGGRYVAKDMGEAGGVPMLLRTLLDAGLLHGDVMTVTGKTLAENLADVVWREDQDVIRPVSNPLSPTGGVVGLWGSLAPEGGIVKVAGLKHQVHRGPARVFDGEAACFEAVSNRDYKAGDVLVIRYEGPRGGPGMREMLSTTAAIYGQGVENIALITDGRFSGATRGLCIGHVGPEAAVGGPIALVQDGDIISIDATKGTIELEVEAEELARRKAAWKPRGHDYNSGAIWKFAQLVGPAYLGATTHPGAAKETHVYADI

SEQ ID NO: 103 - DNA, 1719 bp, Candidatus Pelagibacter ubique
atggcaaaatttaataaaaaaaaattaccaagcagacatacttcattaggtgctgatagagctccacatagatcattttactatgcaatgggtgaaacagaaaaagatgtagcaaagccatttgttggtgttgtgtcaacttggaatgaagctgctccttgtaatattgctttaatgagacaagctcaatctgtcaaaaaaggcgttagagcttcaggtggaacccctagagaattttgtacgataacagtaactgatggtattgccatgggtcacgaaggaatgaagtcatctttaatctctcgcgaggtaattgctgattcaactgaacttactgtgcgtggtcattgttatgatgcgcttgttggtattgctggttgtgataaatctttacctgccttaatgatggcaatggttagattaaatgttccaagtgtatttatttatggtggctcaatacttccaggtcaatataaaggtaaagatgtaactgttgttgatgtttttgaagcagttggaaaacactcagctggaaaaatgtctgcaaaggaattaagaaaattagagttagttgcttgcccaagtgcaggtgcatgtggaggtcaatttactgcaaatactatggcctgcgtttctgaagctattggtttagcattaccttattcagctggaacacctgctccatacgaagaacgtgataagtatgcattattaagtggcaagactgtaatgaatttattacaaaaaaatattcgtccaagagacattgttacaaaaaaatctttagaaaatgctgcaacaattgtagcggctactggtggatcgacaaatgctgctttacacctaccagctatagctaatgaaattggaattaagtttgatttaatggatgtagctaaaatttttaaaaaaactccatatcttgcagatttaaaaccaggtggaaaatatgttgcaaaagatatgtggttagctggtggagtacctatgttattaaaaactctttttgatggtggttttatacatggtgattgcatgactgttactggaaaaacaatgaaacaaaatttaaaaaatattaaatttaatcctaagcaaaaagtattaagagcatatgataatcctttatcaccagatggcggtgttgtaggtcttaaaggtaacttagctcctgatggtggaattgttaaaattgctggtttaaaaaaattacaattcactggaaaagctagatgttttgataatgaagaagcagcaatggcttgtgtgcaaaagaaaaaatataaagcaggtgatgtaattattattcgttacgaaggaccagttggcggtcctggtatgagagaaatgctttcaacaacaggtgctatttatggtcaaggtatgggtgagaaggttgctctaattacagatggtagattttctggggctacaagaggtttttgtgtgggtcatgttggccctgaggcggccttaggcggccctttagctcttttacgcaatggagatgtaattgatatagatgccaaaaaagggactattaacgttagattaactaaatcacaattagccacaagacataagaagtggaaagcaaaaaaatcaagctttggatcgggtactatttggaaatatgctcaaacagtaggtcccgcttatttaggtgcaccaacacatcccggtaaaagaaaagaagtaaaagtttacgctgatatttaa

SEQ ID NO: 104 - protein, 572 aa, Candidatus Pelagibacter ubique
MAKFNKKKLPSRHTSLGADRAPHRSFYYAMGETEKDVAKPFVGVVSTWNEAAPCNIALMRQAQSVKKGVRASGGTPREFCTITVTDGIAMGHEGMKSSLISREVIADSTELTVRGHCYDALVGIAGCDKSLPALMMAMVRLNVPSVFIYGGSILPGQYKGKDVTVVDVFEAVGKHSAGKMSAKELRKLELVACPSAGACGGQFTANTMACVSEAIGLALPYSAGTPAPYEERDKYALLSGKTVMNLLQKNIRPRDIVTKKSLENAATIVAATGGSTNAALHLPAIANEIGIKFDLMDVAKIFKKTPYLADLKPGGKYVAKDMWLAGGVPMLLKTLFDGGFIHGDCMTVTGKTMKQNLKNIKFNPKQKVLRAYDNPLSPDGGVVGLKGNLAPDGGIVKIAGLKKLQFTGKARCFDNEEAAMACVQKKKYKAGDVIIIRYEGPVGGPGMREMLSTTGAIYGQGMGEKVALITDGRFSGATRGFCVGHVGPEAALGGPLALLRNGDVIDIDAKKGTINVRLTKSQLATRHKKWKAKKSSFGSGTIWKYAQTVGPAYLGAPTHPGKRKEVKVYADI

SEQ ID NO: 105 - DNA, 1722 bp, Erythrobacter litoralis
atgtcgtcgagattcgacaagtccaagctgcccagccgccacgtttcggtcgggccagagcgcgcgccgcatcgttcgtattactacgcgatgggtctgaccgagcaggagatcgcgcgacccttcgtcggcattgttagcgcgggcaacgacagcgcgccctgcaacacgacgctcgatgcgcaggcggacatctgtcgcactggcgtcaaccaagcaggcggcatgccgcggcgcttcaacaccatcaccgtgacggacggtatcgccatgggacaccagggcatgaaaagctcgctggtcagccgcgaggtgattgcggactcgatcgagctatcggtgcgcgggcattgctatgatgcgctggtcggattcgccggctgcgacaagagcttgcccggcatgatgatggccatgctgcggctcaatgttccgagcatcttcgtctatggcggatcgatcctgccgggccgcttccacgacaaggacgtgaccgtcgtcgacgtgttcgaagcggtcggccagcacgcggcgggcaattgtccgctgaaagaactgaccgcgctggaaaaggtcgcctgtcccgggcacggcgcgtgcggcgggcagtttaccgccaacaccatggcctgcgtcggcgaagcgatcggcctgtcgctgcccaacagcaatatggcccccgcgccctatcgttcgcgcgaggagatcgcggtggcggcggggcggcaggtcatgacgctgctggagaaaaacctgcgcccgcgtgacatctgcacaagggccgcattcgagaatgcagcacgggtcgtcgcggcaacgggcggctcgaccaatgccgctttgcacctgcctgccatggcccatgaatgcggcatcgacttcgacctgttcgatgtcgccgagacattcaaatcaacaccttatatcgcagacctcaaacctggcgggcgctatgtcgccaaggacatgcacgaggcgggcggggtctacatggcgatgaaaacgctgctggagggcggtttcctcgatcccgaaccgatgaccgtcacaggcaagacgctgggcgagaatatcgaggagatcacctgggaccccgaccagaaggttttctacgacgtatccaatccgatcacgccgaccggcggcgtcgtcgggctcaggggttctctcgcgcccgacggggcgattgtgaaggtggcgggaatggaacggctccagttcagcggcccagcgcgagtattcgattgcgaggaggatgccttcaaggcggtcgagcagcgcgacatcgccgaaggttgcgtcatcgtaatccgctacgaaggccccaagggcggccccggcatgcgcgaaatgctctctactaccgcagcgctctacgggcagggcatgggcgagaaagtggcgctcatcaccgacgggcgcttctccggcgcgacgcgcggcttttgcatcggccatgtcggcccggaagcggcagactgcggcccgattgcgctggtcgaggatggcgatacaatcagcatcgatgccgttgcaggcacgattgagctcgacgtcgatgccgaaacgcttgaaaaacggcgtcaaagctggacaccgcgggcgaacgattaccagtccggcgcgctgtggcgctatgcgaggaacgtcggtcctgcgcatgagggcgcagtgactcatccgggagcgaaatcggaacgccatgtctttgcggatatctag

SEQ ID NO: 106 - protein, 573 aa, Erythrobacter litoralis
MSSRFDKSKLPSRHVSVGPERAPHRSYYYAMGLTEQEIARPFVGIVSAGNDSAPCNTTLDAQADICRTGVNQAGGMPRRFNTITVTDGIAMGHQGMKSSLVSREVIADSIELSVRGHCYDALVGFAGCDKSLPGMMMAMLRLNVPSIFVYGGSILPGRFHDKDVTVVDVFEAVGQHAAGNCPLKELTALEKVACPGHGACGGQFTANTMACVGEAIGLSLPNSNMAPAPYRSREEIAVAAGRQVMTLLEKNLRPRDICTRAAFENAARVVAATGGSTNAALHLPAMAHECGIDFDLFDVAETFKSTPYIADLKPGGRYVAKDMHEAGGVYMAMKTLLEGGFLDPEPMTVTGKTLGENIEEITWDPDQKVFYDVSNPITPTGGVVGLRGSLAPDGAIVKVAGMERLQFSGPARVFDCEEDAFKAVEQRDIAEGCVIVIRYEGPKGGPGMREMLSTTAALYGQGMGEKVALITDGRFSGATRGFCIGHVGPEAADCGPIALVEDGDTISIDAVAGTIELDVDAETLEKRRQSWTPRANDYQSGALWRYARNVGPAHEGAVTHPGAKSERHVFADI

SEQ ID NO: 107 - DNA, 1716 bp, Erythrobacter sp.
atgtccttcgataagtccaagttgccaagccgccatgtctcggtcgggcctgaacgcgcgccccaccgttcctactattacgcgatgggcatgaccgaggaagaaatcgcacgccccttcgtcgctgtggccagtgctggtaacgattccgcgccgtgcaacacaacgctcgatccgcaggcgaatatctgtcgcgaaggcgtcattgcggggggagggaccccgcgccgcttcaacaccatcacggttacggacgggatcgcgatgggccatcagggcatgaagagctcgctggtaagtcgcgaggtcattgcggactccgtcgagctttcggtgcgcggtcattgttacgatgcgcttgtaggatttgccggatgcgacaaaagcctgcccgggatgatgatggccatgctgcggctgaacgtgccgagcatctttgtctatggcggctcgatcctcccaggcactcatcgcggcaaggacgtgacggtcgtcgatgtgttcgaagccgtgggccagcatgctgccgggaattgcccgcttcaggagttgatcgagctcgaaaaggttgcctgtcccggacacggagcctgtggcggccagttcacagccaatacgatggcctgcgtgggtgaggcaatcggattgtcattgccgaacagcaacatggctcctgctccttacagatcgcgtgaagaaatcgctcgcgccgcgggcgagcaggtgatgatactgcttaagcaaaatctgcgcccacgcgacatctgcacgcgcgcggcctttgaaaacgcggcccgcgttgtcgccgcaaccggcggttctaccaatgccgctctgcaccttcctgccatggcgagcgaatgcgggattgatttcgatcttttcgacgttgcggagatcttcaaatcgacaccctacatcgccgacctgaagcccggcggtaagtacgtcgcaaaggacatgcacgaagcgggcggcgtctacatgggcatgaagacactgctcgaaggagggttcctcgatcccgggccgatgactgtgaccggcaagacgctgggcgagaacatcgaggagatcacctggaaccccgatcaaaaggtattctacgacgtaaagaacccgatcaccccgaccggcggtgtggttgggcttaagggctcgctcgcgcccgaaggtgcgatcgtaaaggttgccgggatggaacgtttgcaattcaccggcacggctcgcgtattcgaatgcgaggaagatgccttcgaggcggtcgagaagcgcgacattgtcgaaggcagcgtcatcgtcatccgctacgaaggccccaagggtggacctggaatgcgcgagatgctcgccaccaccgctgcgctttacggccagggtatgggtgagaaagtcgccctcatcacagatgggcggttctcaggcgctacgcgtggtttctgtatcggccatgtcggccctgaagccgcggatggcggaccgatcgctctcgtcgaggatggcgacacgatcagcatcgatgccgagcttggcacgatcgacctggaggtcgaccaaagcgtgcttgaagaacgccgaaaagcatggaagccgcgtacgaacgattatcagtcgggggcgctgtggcgttacgcgcagaatgtcgggtccgcacgaaacggagcgctcactcacccgggcgccaagtctgagacccatgtgtttgcggacatctag

SEQ ID NO: 108 - protein, 571 aa, Erythrobacter sp.
MSFDKSKLPSRHVSVGPERAPHRSYYYAMGMTEEEIARPFVAVASAGNDSAPCNTTLDPQANICREGVIAGGGTPRRFNTITVTDGIAMGHQGMKSSLVSREVIADSVELSVRGHCYDALVGFAGCDKSLPGMMMAMLRLNVPSIFVYGGSILPGTHRGKDVTVVDVFEAVGQHAAGNCPLQELIELEKVACPGHGACGGQFTANTMACVGEAIGLSLPNSNMAPAPYRSREEIARAAGEQVMILLKQNLRPRDICTRAAFENAARVVAATGGSTNAALHLPAMASECGIDFDLFDVAEIFKSTPYIADLKPGGKYVAKDMHEAGGVYMGMKTLLEGGFLDPGPMTVTGKTLGENIEEITWNPDQKVFYDVKNPITPTGGVVGLKGSLAPEGAIVKVAGMERLQFTGTARVFECEEDAFEAVEKRDIVEGSVIVIRYEGPKGGPGMREMLATTAALYGQGMGEKVALITDGRFSGATRGFCIGHVGPEAADGGPIALVEDGDTISIDAELGTIDLEVDQSVLEERRKAWKPRTNDYQSGALWRYAQNVGSARNGALTHPGAKSETHVFADI

SEQ ID NO: 109 - DNA, 1815 bp, Comamonas testosteroni
atgaacgattcccgctccaccgatccccaggccgctgtcagcggccacgctgaaccctccgactcctctgtgtcatcctccgccccgggcctgcgctcggccatcgtgcaccgcggcaccttgcgcgccagcgcgcgcagctttctgcatgcgctgggccaggacgatgaggagattgcacgcccgcatgtgggcgtgttccatacgggcggggagatgagcccctgcaatatgaatctccgcgaccaggcccagcatgccaagaccggcatctacgcgggaggcggcatgccgcacgagtgccccgtggtctcggtcagcgacggcctgaccatggcgcattcgggcatgcgcttttcgctgatctcgcgcgagctcatcgccgacagcgtggaggcctcggtgcgcggccaccagtgggacggtatctttgccgtgggtgcctgcgacaagaacctgccgggcctgatgatggccatggtgcgctgcaatgtgcccagcgtcttcgtgcatggcggctcggccctgcccgggcagatgccgggcagcgtatcggggcgcgcccttaacgtggtcgacacctacgagaccataggcaaggtgctggccggcacttccaccatgcaggagctggacaccgtcacgcgctcctgcctgccctcggccggggcctgtgccgggcagttcacggccaacaccatgggcatggtcagcgaggccctgggcctggcgcccataggctccagcatggtgccggccgtgttcagcgaacgcgcgccgctgatgcgccgcgcgggccgtcagctcatggaaatggtgtgggccagcgccaggggagaggccgtgctgccgcgcgacatcgtcacgcgcaaggccctggaaaatgcctgtgccgtggtctgcgccacgggtggctccacgaatgcggccctgcacctgccggcgatcgcgcacgaggccggcatacgctttcacctcgacgacgtggccgagatctttgcgcgcacgccgctgatcgcagacctcaagcccggcggccgcttcctggcacgtgatgtctactacatcggcggtgcggctgtcatcctgcgcaccctgctggagcagggcctgctgcatggcgatgcactcaccttcacgggccgcacgctggccgaggaggtggccgatgctgccgagcccgacggcgaagtggtgcgcaaggccggcaacccgatctcggccgacggtgggctcacggtgctcaagggcaatctgtgccctgacggtgccctgctcaagacggcggggctcaagaccctggtgcaccgcggtccggcccgcgtcttcgactccgaggaacaggcgcaggacgccgtgcaggccatggcctaccggagcggcgatgtgctggtgatacgcaacgaaggccccaagggcagccccggcatgcgcgagatgctgggcatcactgccttgctctatggccagggcatgggcgacaaggtggcactgctcaccgacgggcgcttctcgggcgccacgcgcggcctgtgcataggctacgcggggccggaggccgctgacggtgggccgattgccgcactgcaggacggcgacatcatcgccatcgatgcgcgggccggcgcgcgcagcatcacggtggagctggagcccgccgtcattgccgcgcggctggaagccgcccgggccagccgtgcgcagcagcgccccctgggcgggctgctggagaaatacgcgctgaccgtgcgtcccgcccaccagggcgcggtcacgcattcgggggcggtgacctggctgcgcgacagcaagtga

SEQ ID NO: 110 - protein, 604 aa, Comamonas testosteroni
MNDSRSTDPQAAVSGHAEPSDSSVSSSAPGLRSAIVHRGTLRASARSFLHALGQDDEEIARPHVGVFHTGGEMSPCNMNLRDQAQHAKTGIYAGGGMPHECPVVSVSDGLTMAHSGMRFSLISRELIADSVEASVRGHQWDGIFAVGACDKNLPGLMMAMVRCNVPSVFVHGGSALPGQMPGSVSGRALNVVDTYETIGKVLAGTSTMQELDTVTRSCLPSAGACAGQFTANTMGMVSEALGLAPIGSSMVPAVFSERAPLMRRAGRQLMEMVWASARGEAVLPRDIVTRKALENACAVVCATGGSTNAALHLPAIAHEAGIRFHLDDVAEIFARTPLIADLKPGGRFLARDVYYIGGAAVILRTLLEQGLLHGDALTFTGRTLAEEVADAAEPDGEVVRKAGNPISADGGLTVLKGNLCPDGALLKTAGLKTLVHRGPARVFDSEEQAQDAVQAMAYRSGDVLVIRNEGPKGSPGMREMLGITALLYGQGMGDKVALLTDGRFSGATRGLCIGYAGPEAADGGPIAALQDGDIIAIDARAGARSITVELEPAVIAARLEAARASRAQQRPLGGLLEKYALTVRPAHQGAVTHSGAVTWLRDSK

SEQ ID NO: 111 - DNA, 1707 bp, Sphingomonas wittichii
atgacgacccgaaaatttcgatccgagatcatccgcgaaggcgtggtccgaacgaccacgcgcagcttcctctacgccctgggcgaggacgacgaggatctgcggcagcctcatgtcgccgtcatccacaccggcggcgagatgagcccgtgcaacaccacgctgcgcgatcaggcgctccacgccaagacgggcatctatgcgggtggcggcacggcgcatgaatgcccggtggtgtcggtgtcggacgggctgtcggtggcgcattcggggatgcgcttctcgctgatctcgcgcgagctgatcgccgacagcgtggaggcgaccgtccggagccatcaatgggatggcgtcctcgcggtcggcggctgcgacaagaacatgcccggcctgatgatgggcatcgtgcgctgcaacgtcccctcggtcttcctctatggtggggcagccctgcccggccatctcggcggccgcgacgtcaacatcgtcgacacctatgagatgatcggccgggtcctggcgggagaggcgacgcaaggggaactggaggacatggcccgcgcctgtcttccgacggcgggagcctgtgccggccaatataccgccaacaccatgggcatggtgtcggaagcgctcggcctggcgctgctgggctcctcgatgatcccggcggtctatgccgcccgggcgccgatggcgcgcaaggcgggcaaggtgctgatgcgagcggtgctcggcggtgggccgctgccgcgcgacatcgtcacccgcaaggcgctggaaaatgcctgcgccgtggtcgccgccaccggcggttcgaccaacgcgccgctgcaccttcccgcgatcgccaacgaagcggggatcgatttcgacctcgacgatgtcgccgcagtgctcgcccgcacgccgctgatcgccgatctcaagcccggcggccgcttcctggccaaggacgtgttcgagatcggcggcaccccggtgatcctgaaggccctgctcgacggcggccatctccatggcgactgcatgacggtcaccgggcggacgctcgccgaagacctcgccaaggtctgcccgccggacggggcggtggtccgcgactgcggcatgccgatcgcgccgtccggcggcgtgaccgtgctcaagggcaatctggccccagacggcgcactgctgaagaccgccggcctgaagaagctcgagcatcgcggccccgcccgcgtcttcgagtccgaggagcaatgcctctccgccgtgcgggcgatggcctatgcggccggcgacgtcatcgtgatccgcaacgaagggccgcgcggcggccccggtatgcgcgagatgctgggcatcaccgcgctgctctacggccagggcatgggggagaaagtcgccctgatcacggacggccgcttctcgggcgcgacccggggcatgtgcatcggctatatctcgcccgaagcggccagtgatggaccgatcggcctggtccgcgacggtgatctcatcgccatcgacgcgcgcgacggcatcgtcagtttgcaggtcgaactgccaaaaggtgagttggaggcgcgtcgcgccctgccccgccccgcccgtgttcgtccgaaaggaggggtcctcgaaaaatatgcggcgatcgttggaccggccaacaagggcgccgtaacccatagcggcaacgtcatatgggagatggatccgtga

SEQ ID NO: 112 - protein, 568 aa, Sphingomonas wittichii
MTTRKFRSEIIREGVVRTTTRSFLYALGEDDEDLRQPHVAVIHTGGEMSPCNTTLRDQALHAKTGIYAGGGTAHECPVVSVSDGLSVAHSGMRFSLISRELIADSVEATVRSHQWDGVLAVGGCDKNMPGLMMGIVRCNVPSVFLYGGAALPGHLGGRDVNIVDTYEMIGRVLAGEATQGELEDMARACLPTAGACAGQYTANTMGMVSEALGLALLGSSMIPAVYAARAPMARKAGKVLMRAVLGGGPLPRDIVTRKALENACAVVAATGGSTNAPLHLPAIANEAGIDFDLDDVAAVLARTPLIADLKPGGRFLAKDVFEIGGTPVILKALLDGGHLHGDCMTVTGRTLAEDLAKVCPPDGAVVRDCGMPIAPSGGVTVLKGNLAPDGALLKTAGLKKLEHRGPARVFESEEQCLSAVRAMAYAAGDVIVIRNEGPRGGPGMREMLGITALLYGQGMGEKVALITDGRFSGATRGMCIGYISPEAASDGPIGLVRDGDLIAIDARDGIVSLQVELPKGELEARRALPRPARVRPKGGVLEKYAAIVGPANKGAVTHSGNVIWEMDP

SEQ ID NO: 113 - DNA, 1767 bp, Burkholderia xenovorans
atgaccaatctgcataaacaccgctcccgcatggtgaccgatggtgtgacgcgtgcgccgcaccgtgcctttctgcgcgcgacaggcctcgacgatgcgtcgatgcaaaagccgttcgtcgcgatcgtcgatacgtttggcgagaacacgccgtgttcgatgtcgctgaaccaggtgtccgataacgcacgtctcggcgttgccgctggcggcggcataccgattcgcggctcggcgatctcggtgtcggacggtacctcgatgaatcattcggggatgcgcatgagccttgtatcgcgcgagatcgtcgcggacagcgtcgagctgttcgtgcgtgcccatgcctacgatgcgctgatcggcgtggccggctgcgacaagacgctgcccggcatcctgatgggcatggttcgcgtcaacgtgcccggcgcgttcctgttcggcggcgcgatgctgccgggcgtggcgcccgggcagatccccggcggaggcggcacgggccagcaacgccaggcaacgatcctcacgaccatcgaagcggtgggcaccgcgcagcgcggcgacatcacccgcgcgcagctcgacgccatcgaaaagcagtgcacgccgaccgccggctcatgtcccggccagttcaccgcgaacaccatggcgatggtcgcggaagcgctgggactcgccccgctcggctcggcgatggtgccggccgtctatagcgaacgcattgcgattgcgcggcgcgctggcgaaacggtgatgcgcacgctcaaggaaggcgccccgctgccacgcgatctggttacgctgaaaagcctggagaatgcctgcgccgccgttgccgcgacgggcggctcgaccaacgccgcgctgcacattccggcgatcgcgcatgaagccggcatccgcttcacgctcgacgacgtgcagcgcgtgttcgcgcgcattccgctgatcggcgacctgcagcccggcggccgctatctcgcgcaggacctgcatcatgcgggcggcgtgccggcggtgctcaacgcgttgctggccggtggctatctgcatggcgacgccctcacgctcgacggcctcacgctggaagacgcgttgcgcggctacgccggtcccgatggcacggtggtgcgttcatgcgatgaaccgctcggcgagaacggcggcctcgtgatcctgcgcggcaatctcgcaccggacggtgcgtgcctgaaaatcgccgggctcaaagcgctgaccttctcaggtaagacgcgcatcttcgaatgcgaggaagactgcatggcggtggtcgctgcacgcgattatcgcgaaggcgacgtcctcgtgatccgcaacgaagggccgaagggcggtcccggcatgcgggagatgctcagcgtgaccgcggcgatctacggacaaggcatgggcgagaaagtcgcgctgctgaccgatggacgcttttcgggggcgacgcgcggcatgtgtatcggttatgtcggaccggaagcggcggtgggcggtccgattgcgctgctgcgcgatggtgatcgggtgcagatcgatgcgcgcgcgggaacgctgcgcgtcgagctatccgacgacgaactcgcgcgacgccgtgcggatctgccggcgaggccaaggcgccggctcgccggcgtgctggagaagtacgaggcgctggtgcggcctgcgcatctcggggcggtcacgcattcgggcaatctcgattggccctacgatgcgccgacgcatggcgacgacggagccgccgcgtga

SEQ ID NO: 114 - protein, 588 aa, Burkholderia xenovorans
MTNLHKHRSRMVTDGVTRAPHRAFLRATGLDDASMQKPFVAIVDTFGENTPCSMSLNQVSDNARLGVAAGGGIPIRGSAISVSDGTSMNHSGMRMSLVSREIVADSVELFVRAHAYDALIGVAGCDKTLPGILMGMVRVNVPGAFLFGGAMLPGVAPGQIPGGGGTGQQRQATILTTIEAVGTAQRGDITRAQLDAIEKQCTPTAGSCPGQFTANTMAMVAEALGLAPLGSAMVPAVYSERIAIARRAGETVMRTLKEGAPLPRDLVTLKSLENACAAVAATGGSTNAALHIPAIAHEAGIRFTLDDVQRVFARIPLIGDLQPGGRYLAQDLHHAGGVPAVLNALLAGGYLHGDALTLDGLTLEDALRGYAGPDGTVVRSCDEPLGENGGLVILRGNLAPDGACLKIAGLKALTFSGKTRIFECEEDCMAVVAARDYREGDVLVIRNEGPKGGPGMREMLSVTAAIYGQGMGEKVALLTDGRFSGATRGMCIGYVGPEAAVGGPIALLRDGDRVQIDARAGTLRVELSDDELARRRADLPARPRRRLAGVLEKYEALVRPAHLGAVTHSGNLDWPYDAPTHGDDGAAA

SEQ ID NO: 115 - DNA, 1767 bp, Burkholderia phytofirmans
atgaccaatctgcacaaacatcgctcgcgcagggtgaccgacggcgtcacccgcgcgccgcatcgcgcgttccttcgcgctaccggcctcgacgacgaatccatgcaaaagccgttcgtcgcgatcgtcgatacgttcggcgagaacaccccgtgttcgatgtcgctgaaccaggtctccgacaacgtgcgcctcggcattgcagcgggcggtggcgtgccgatccgcggctcggcgatctcggtgtcggacggcacgtcgatgaatcactccggcatgaggatgagcctcgtgtcgcgcgaagtggtcgcggacagcgtcgaactgttcgtgcgtgcgcataactacgacgcactgatcggcgtcgccggttgcgacaagaccttgcccggcatcctgatgggcatggtgcgcgtcaacgtgcccggtgtgttcctgttcggcggcgcaatgctgcccggcgtcgcacccggtcagttgcccggcggcgccggcaccggcctgcaacgccagtcgacgattctcacgacaatcgaagcggtcggcaccacgcagcgtggcgacatgagccgcgcgcaacttgacgccatcgaaaaacaatgcacgccgactgccggatcgtgtcccggccagttcaccgcgaataccatggcgatggtcgcggaaacgcttggcctcgcgccgctgggctccgcgatggtgcccgccgtctacagcgaacggattgcgattgcgcgccgcgccggcgagacagtcatgcgtatcctgacgcaaggcgggcccttgccgcgcgatctcgttacgatggaaagcctggagaacgcctgcgcggcagttgccgcgaccggcggttcgaccaatgccgcgctgcacattccggccatcgcgaacgaggccggcattcgcttcgcgctggacgacgtgcaacgcgtgttcgcgaaaattccgctgatcggcgatctgcaaccaggcggccgctatctcgcgcaggatctgcatcacgcgggcggcgtgccggccgtgttgaacgcgctgctggcaggcggcttcctgcatggcgatgtgcccgcgttcggcggcggcacgctcgccgaagcattgagcgcgttcagcggaccggacggcatcgtcgtgcgtccgtgcgacgagccgctcggcgaaaacggcggactcgtgatcctgcgtggcaacctcgcgccggacggcgcatgtctgaaaatcgccgggctcaaatcgctttcgttcacgggcgcggtgcgtgtattcgaatgcgaagaagactgcatggcggttgtcgcggcgcgcgactaccgcgaaggcgacgtgctcgtgatccgtaacgaagggccgaaaggcggtcccggtatgcgcgaaatgctgggtgtgacagcagcgatctacggtcagggcatgggcgagaaagtggcgttgttgaccgacggtcggttttcgggcgcgacacgtggcatgtgcatcggctatgtcggcccggaagcggcggcgggtggcccgatcggcctgttgcgcaatgacgaccgcgtgcatatcgacgcgcgcgcaggcattctgcgcgtcgacctgtccgacgacgaactcgcccgtcgccgcgccgacgcgccagcgcgcgcgtcgcgccggctcgcgggggtgctcgaaaaatacgaagcgttggtgcggcccgcgcatctcggcgcggtgacgcattcgggcaacgttgaatggccatacgacgaacccacgcccggcgacgacggagccgccgcatga

SEQ ID NO: 116 - protein, 588 aa, Burkholderia phytofirmans
MTNLHKHRSRRVTDGVTRAPHRAFLRATGLDDESMQKPFVAIVDTFGENTPCSMSLNQVSDNVRLGIAAGGGVPIRGSAISVSDGTSMNHSGMRMSLVSREVVADSVELFVRAHNYDALIGVAGCDKTLPGILMGMVRVNVPGVFLFGGAMLPGVAPGQLPGGAGTGLQRQSTILTTIEAVGTTQRGDMSRAQLDAIEKQCTPTAGSCPGQFTANTMAMVAETLGLAPLGSAMVPAVYSERIAIARRAGETVMRILTQGGPLPRDLVTMESLENACAAVAATGGSTNAALHIPAIANEAGIRFALDDVQRVFAKIPLIGDLQPGGRYLAQDLHHAGGVPAVLNALLAGGFLHGDVPAFGGGTLAEALSAFSGPDGIVVRPCDEPLGENGGLVILRGNLAPDGACLKIAGLKSLSFTGAVRVFECEEDCMAVVAARDYREGDVLVIRNEGPKGGPGMREMLGVTAAIYGQGMGEKVALLTDGRFSGATRGMCIGYVGPEAAAGGPIGLLRNDDRVHIDARAGILRVDLSDDELARRRADAPARASRRLAGVLEKYEALVRPAHLGAVTHSGNVEWPYDEPTPGDDGAAA

SEQ ID NO: 117 - DNA, 1713 bp, Bordetella petrii
atgtcactgcacaaacaccgctcgcggatggtcaccgacggcctgacccgggcgcctcaccgggcctttctgcgcgccaccgggttcgacgacgaagccctgaagaaatcaatcgttggcattgtcagtacccaaggcgaaaacacgccctgctcgatggccctggcgccccaggcggaccgcgcccgcctgggcgtggcggccgggggcggcgtgccggtcagtttttcgaccatttcggtgtcggatggcacgtccatgaaccatgccggcatgcgcatgagcctgctttcgcgcgaggcgatcgccgacagcgtggaaatggtgatgcgcggccacgcctatgacggactggtggcgttcgccggctgcgacaagacgctgcccgccatgatgatggcgatcgtgcgcctgaacgtgccggcggtgtttctctacggcggcgcgacgttgcccggccacgcgctcggcaagcaggccaccatcctggacaccatcgaggcagtgggccgcgtgcagcatggcggcatgacggccgccgagctcaagaccatggagcgtacttgcacgccatcggccggctcgtgcccgggccaattcaccgccaacaccatggccatggtcggagaagccctgggcttgtcgcccctgggcaccgccatgatgcccgcggtgtacagcgaacgcctggccatcgcccagcgggccggcgaacaagtcatgcgcgccctggcccaaggcggccccctgccgcgcgacctggtcacgcgcgccagcctggacaatgcctgcgccgcggtggctgccaccggcggctcgaccaacgcggcgctgcacattcccgccatcgctcacgaagccggcatccgctacacgctggatgacgttgccgccgtattccagcgcacgccattgatcgcggacttgcagccgggcggacgcttcctggcgcgcgacctgcacgaagcgggcggcgtgcccgccgtactgaaagccctgctggaaggcggttatatcgacggcaacgtgccgacgctcgacggccggccgctggcgcgagccctggtcgacttcgccgggccggacggcgaggtggtgcgcccctgctcgcgcgcgatccacccttcgggcggcgtcacggtgctgaaaggcaacctcagcccgcaaggcgcgctgctcaagatcgcgggcctgaaatcgctgcaattctccgggccggcgcgcgtgttcgaaaacgaagaagactgcatgcgcgcggtgtcacagcgcacctaccagcccggcgacgtgctggtcatccgcaacgaaggcccccagggcgggccgggcatgagagagatgctcagcgtgaccgccgcactgtatggacagggcatgggcgaaaaagtggccctgctgaccgacggccgcttctcgggcgcgacgcgcgggctgtgcatcggttatgtgggccccgaggccgcggcgggcggccccatcgccttcgttcgcgacggcgacatcatccatatcgacgcccaggccaataccttgcgcgtcgaactcagcgacgccgaactggccgcccgccgcgccagccatgtgccgccggcacggccgcgcctggccggcgcgctcgaaaaatacgccttgctggtgcggccggcgcacgaaggcgccgtcacgcactcggggggattggattggccctacgaaaccccggaggccgaatga

SEQ ID NO: 118 - protein, 570 aa, Bordetella petrii
MSLHKHRSRMVTDGLTRAPHRAFLRATGFDDEALKKSIVGIVSTQGENTPCSMALAPQADRARLGVAAGGGVPVSFSTISVSDGTSMNHAGMRMSLLSREAIADSVEMVMRGHAYDGLVAFAGCDKTLPAMMMAIVRLNVPAVFLYGGATLPGHALGKQATILDTIEAVGRVQHGGMTAAELKTMERTCTPSAGSCPGQFTANTMAMVGEALGLSPLGTAMMPAVYSERLAIAQRAGEQVMRALAQGGPLPRDLVTRASLDNACAAVAATGGSTNAALHIPAIAHEAGIRYTLDDVAAVFQRTPLIADLQPGGRFLARDLHEAGGVPAVLKALLEGGYIDGNVPTLDGRPLARALVDFAGPDGEVVRPCSRAIHPSGGVTVLKGNLSPQGALLKIAGLKSLQFSGPARVFENEEDCMRAVSQRTYQPGDVLVIRNEGPQGGPGMREMLSVTAALYGQGMGEKVALLTDGRFSGATRGLCIGYVGPEAAAGGPIAFVRDGDIIHIDAQANTLRVELSDAELAARRASHVPPARPRLAGALEKYALLVRPAHEGAVTHSGGLDWPYETPEAE

SEQ ID NO: 119 - DNA, 1713 bp, Bordetella bronchiseptica
atgtccctgcataagcaccgttcccgcatggttacccaaggcctgacgcgcaccccgcatcgcgccttcctgcgcgccaccggcttcgacgacgccgccctggagaaatccatggtcggcatcgtgagcacgcaaggcgagaacacgccctgctccatggcgctggggccgcaggccgaccgcgcccgcctgggcgtggccgccggcggcggcgtgccggtcagcttctcgaccatctcgatctccgacggcacctcgatgaaccatgcgggcatgcgcatgagcctgctgtcgcgcgagaccatcgccgacagcgtcgagctggtggtgcgcggccacgcctatgacgcactggtggcgttcgccggctgcgacaagacgctgccggccatgatgatggccatcgtgcggctgaacgtgccggcggtgttcctgtacggcggcgccaccctgcccggccatgcggccagcggccaggtcaccatcctcgacaccatcgaagccgtcggccgggtacagcacggcaccatgccggcggccgagctcaaggcgatggagcgcacctgtacgccctcggcgggctcgtgcccgggccagttcaccgccaacaccatggccatggtgggcgaggcgctgggcctgtcgccgctgggttcggcgatgatgcccgcggtctacagcgaacggctggccatcgcgcagcgcgccggcgagcacgtgatgcgcgccctggccgcgggcggcccgctgccgcgccagctggtgacgcgcgccagcctggagaacgcctgcgccgcggtggcggccaccggcggctcgaccaacgcggccctgcacattccggccatcgcgcacgaggccggcatcgccttcacgctggacgacgtggcccgggtgttcaagcgcacgccgctgatcgccgacctgcaacccggcggccgctatctggcgcgcgacctgcacgaggccggcggcgtgccggtggtgctcaaggcgctgctggacggcggccatatcgacggcagcgtgctgacgctcgacggccgcaccctggccgaggccctggccgacacgcccgcgcccgacggcaaggtggtgcgcgcctgcggccaggccctgcaccccaccggcggcgtcgccgtgctcaagggcaatctcagccccgatggcgcgctgctgaagatcgccggcctgaagtcgctgaaattctccgggccggcgcgcgtgttcgagaacgaggaagcctgcatgcgcgcggtgtccacgcacgcctaccagccgggcgaagtcctggtcatccgcaacgaaggcccccggggcgggccgggcatgcgcgagatgctcagcgtcacggccgccctgtatggacagggcatgggcgagaaagtggcgctgctgaccgacggccgcttctcgggcgccacgcgcggcctgtgcatcggctacgccgggccggaagcggccgccggcggccccatcgcgctgctgcgcgatggcgacatgatccacatcgacgccgaggccgatacgctggacgtggcgctgtccgacgaagagctggcgcggcgccgcgccgcctaccaggcgccgccgcaggcgcgcctggccggcgcgctggagaaatacgccgcgctggtgcgcccggcctgcctgggcgcggtcacccactccggccaggtcgattggccttacgaaacgccggaggccgaatga

SEQ ID NO: 120 - protein, 570 aa, Bordetella bronchiseptica
MSLHKHRSRMVTQGLTRTPHRAFLRATGFDDAALEKSMVGIVSTQGENTPCSMALGPQADRARLGVAAGGGVPVSFSTISISDGTSMNHAGMRMSLLSRETIADSVELVVRGHAYDALVAFAGCDKTLPAMMMAIVRLNVPAVFLYGGATLPGHAASGQVTILDTIEAVGRVQHGTMPAAELKAMERTCTPSAGSCPGQFTANTMAMVGEALGLSPLGSAMMPAVYSERLAIAQRAGEHVMRALAAGGPLPRQLVTRASLENACAAVAATGGSTNAALHIPAIAHEAGIAFTLDDVARVFKRTPLIADLQPGGRYLARDLHEAGGVPVVLKALLDGGHIDGSVLTLDGRTLAEALADTPAPDGKVVRACGQALHPTGGVAVLKGNLSPDGALLKIAGLKSLKFSGPARVFENEEACMRAVSTHAYQPGEVLVIRNEGPRGGPGMREMLSVTAALYGQGMGEKVALLTDGRFSGATRGLCIGYAGPEAAAGGPIALLRDGDMIHIDAEADTLDVALSDEELARRRAAYQAPPQARLAGALEKYAALVRPACLGAVTHSGQVDWPYETPEAE

SEQ ID NO: 121 - DNA, 1707 bp, Bradyrhizobium sp.
atgaggaagctgcgttcgcgcgtgacggtggaggggctcgaccgcgccccgcaccgcgccttcatgcgcgcgatgggcctcgatgacgccgacatcgccaagccgatgatcggaatcgtcagtcagaggggcgagcagacgccctgcaacatgacgcacgacttccaggtcgatgccgccaagaccggcatctccgagtccggcggcacgccgcgcgaattcgccaccgtctccgtctccgacggcatcagcatgaaccatgagggaatgaagttctctctgttctcccgcgagctgatcgccgattcgatcgaggccgtggtgcacggcctagcctatgacgcgctgatcggcttcggcggctgcgacaagaccttgcccggcgtgatgatgggtatggtccgctgcaacgtgccgtcgatcttcatctatggcggcagcgcgctgcccggcaagtaccagggcaagacgctcacggtgctcgactcctacgaagcggtcggcagctacatgaccggcgagatcgatgccgccacgctcgaaggcatcgagcgctcgtgcctgccgacgatcggcgcctgcgccggccagttcaccgcgaacaccatgggcatgctgtctgaggcgatgggcctgtcgatgcccaacgtctcgatgatccccggcgtctatgccgagcgcgcccatgtcgcgcgcgcagccgggcgcctgatcatgcagatgctcgccaacgatggcccgcggccgcgcgacatcgtcacccgcaaatccctggagaacggcgcggcgatcgtcgccgccaccggcggctcgaccaacgcggccctgcatctgcctgcgatcgcgaacgaggccggcatccgcttcacgctcgacgatgtcggcgaggtgttttcgcgcacgccgctgatcggcaatctcaggcccggcggcaagtatacggcgaaggacgtgtatgacatcggcggcgcggccgtcgtgatccgcgcgctgatcgacagcggccacatcgacggctcctgcatcacggtgaccggccgtacgctcgccgaggcctgcggcgcggccaatgcgccggatggcgaggtcgtgttcacgccggccaggccgatgatggccgacggcggcgtcgccgtgctcaagggcaatctcgcgccggatggtgcggtcatcaaggtcgccggtctcaagagcctggtgttcgagggccgcgcgcgcgtgtttgaagatgaagaagcctgcgtcgccgccgtccgcgcccgcaactaccaggcgggcgaggtgctgatcatccgtaacgaggggccggtcggcggccccggcatgcgcgagatgctcggcgtcaccgcgctgatctatggccagggcatgggcgagaaggtcgcgctgatcaccgacggccgcttctccggtgccacccgcggtttatgcatcggctacgtctcgccggaagccttcgtcggcggcccgctggcgctggtgcgtgatggcgatcccattcgcatcgatgcgaaagcgcgcacgctcgacgtgctgctcgacgagggcgagctcgccgcgcgtcgcagcgcgtggacgcagcggccgccgcggcatcgcgcgggagcgctggcgaaatacgcgaaactggtggggcaggcgccgctcggcgcggtcacgcatgagggaccggcggaatggccctggttcgatcaggagcaggaatga

SEQ ID NO: 122 - protein, 568 aa, Bradyrhizobium sp.
MRKLRSRVTVEGLDRAPHRAFMRAMGLDDADIAKPMIGIVSQRGEQTPCNMTHDFQVDAAKTGISESGGTPREFATVSVSDGISMNHEGMKFSLFSRELIADSIEAVVHGLAYDALIGFGGCDKTLPGVMMGMVRCNVPSIFIYGGSALPGKYQGKTLTVLDSYEAVGSYMTGEIDAATLEGIERSCLPTIGACAGQFTANTMGMLSEAMGLSMPNVSMIPGVYAERAHVARAAGRLIMQMLANDGPRPRDIVTRKSLENGAAIVAATGGSTNAALHLPAIANEAGIRFTLDDVGEVFSRTPLIGNLRPGGKYTAKDVYDIGGAAVVIRALIDSGHIDGSCITVTGRTLAEACGAANAPDGEVVFTPARPMMADGGVAVLKGNLAPDGAVIKVAGLKSLVFEGRARVFEDEEACVAAVRARNYQAGEVLIIRNEGPVGGPGMREMLGVTALIYGQGMGEKVALITDGRFSGATRGLCIGYVSPEAFVGGPLALVRDGDPIRIDAKARTLDVLLDEGELAARRSAWTQRPPRHRAGALAKYAKLVGQAPLGAVTHEGPAEWPWFDQEQE

SEQ ID NO: 123 - DNA, 1707 bp, Bradyrhizobium sp.
atgaggaagctgcgctcgcgcgtcacggtggaggggctcgatcgtgccccgcaccgcgccttcatgcgcgcgatggggctggatgatgccgacatcgccaagccgatgatcggcatcgtcagccagaagggcgagcagacgccctgcaacatgacgcacgacttccaggtcgacgccgccaagacgggcgtctccgaagccggtgggacgccgcgcgaattcgccaccatctcggtgtcggacggcatcagcatgaaccatgagggaatgaagttctctctgttctcgcgcgaactgatcgcggattcgatcgaggccgtggtccatggtctcgcttatgacgcgctgatcggctttggcggctgcgataagaccctgccgggcgtcatgatgggcatggttcgttgcaacgtgccgtcgatcttcatttatggcggcagcgctctgcctggcaagttccagggcaagacgctcacggtgctcgattcgtatgaagcggtcggcagctacatgaccggcgagatcgatgtcgcgacgctcgagggcatcgagcggtcgtgcctgcccaccatcggcgcctgcgccgggcagttcaccgccaacaccatgggcatgctgtccgaggcgatgggcctgtcgatgcccaacgtctcgatgatccccggcgtctatgccgagcgcgcccatgtcgcgcggcaggccggccggctgatcatgcagatgctggctcgtggtgggccgctgccacgcgatatcgtgacccgcaaggccctggagaacggtgcggcgatcgtcgccgccaccggcggctcgaccaatgccgcgctgcatctgccggcgatcgccaacgaagccggcatccgtttcacgctcgacgatgtcggcgaggtcttcgcccgcacgccgctgatcggcaatctccggccgggcgggaagtacaccgccaaggacgtctatgacatcggcggcgcggccgttgtgatccgcgcgctgatcgagagcggccatatcgacggctcctgcatgacggtgaccggccgcacgcttgccgaggactatggggccgccaatgcgcccgatggcgagatcgtgtttcatccggccagcccgatcatggcggagggcggcgtcgccgtgctcaagggcaatctggcgcctgacggcgcggtcatcaaggtggccggcctgaagaacctcgtattcgaggggcgggcccgcgtattcgaggatgaggaagcctgcgtcgccgccgtccgcgcgcgcaactatcaggcgggcgaggtactgatcatccgcaacgaggggccggtcggcggtcccggcatgcgcgaaatgctcggtgtgaccgcactgatctacggtcagggcatgggcgagaaggtggcgctgatcaccgacggccgcttctccggagcgacgcgcggcatgtgcattggctatgtctcgccggaagccttcgtcggcggtccgttggcgctgctgcgcgacggcgatccgattcgcatcgatgcaaaagcgcgcacgctcgacgtcctgctcgacgacgccgagctcgcggcccgtcgcgccgcgtggtcgcagcggccgccacggcatcgcgccggcgcgctggcgaaatatgccaagctcgtcggccaggcaccgctcggcgccgtgacgcatgaaggacccgcggactggccgtggttcgatcaggagcagaaatga

SEQ ID NO: 124 - protein, 568 aa, Bradyrhizobium sp.
MRKLRSRVTVEGLDRAPHRAFMRAMGLDDADIAKPMIGIVSQKGEQTPCNMTHDFQVDAAKTGVSEAGGTPREFATISVSDGISMNHEGMKFSLFSRELIADSIEAVVHGLAYDALIGFGGCDKTLPGVMMGMVRCNVPSIFIYGGSALPGKFQGKTLTVLDSYEAVGSYMTGEIDVATLEGIERSCLPTIGACAGQFTANTMGMLSEAMGLSMPNVSMIPGVYAERAHVARQAGRLIMQMLARGGPLPRDIVTRKALENGAAIVAATGGSTNAALHLPAIANEAGIRFTLDDVGEVFARTPLIGNLRPGGKYTAKDVYDIGGAAVVIRALIESGHIDGSCMTVTGRTLAEDYGAANAPDGEIVFHPASPIMAEGGVAVLKGNLAPDGAVIKVAGLKNLVFEGRARVFEDEEACVAAVRARNYQAGEVLIIRNEGPVGGPGMREMLGVTALIYGQGMGEKVALITDGRFSGATRGMCIGYVSPEAFVGGPLALLRDGDPIRIDAKARTLDVLLDDAELAARRAAWSQRPPRHRAGALAKYAKLVGQAPLGAVTHEGPADWPWFDQEQK

SEQ ID NO: 125 - DNA, 1749 bp, Bradyrhizobium japonicum
atgaagttgcgatgtcccgccgcgtacgggacatcgcacgtagatgatgcaaatatgaagaagttgcgatcacggataacgacagacggcctcgaccgggccccgcaccgcgcattcatgcgcgcaatggggctggacgatgcggcaatcgccaagcccatggtaggcattgtcagcatgaagggcgagcagacgccctgcaacatgacccacgacttccaggtggccgcggccaagacaggtattgaggaggccggcggcacgccgcgcgaattctcgaccgtgtcggtctctgacgggatcagcatgaatcacgagggaatgaagttctccctcttttcgcgcgagctgatcgccgactcgatcgaggctgtcgttcatggtctcgcctatgacgcgttgatcggatacggcggatgcgacaagacgcttcccggcgtgatgatgggcatggttcgttgcaacgtgccgtcgattttcatctacggcggcagttcgctgccggggcgcgtggacggacgaacgctgacagtgctcgactcctacgaggctgtcggcagcttcatgaccggagagatcgatagcgccacactggagcggatcgagcgcgcctgcctgccgaccatcggtgcgtgcgcgggccagtttactgcgaacaccatgggaatggtgtcggaggcgatggggctcaccattcccaacgtctcgatggtgcccggtgtctacgccgagcgcgcgcagatctcgcgacgcgccgggcggctgatcatggaaatgctggaacgcggtgggccgctgccacgggacatcgtgacgcggaaatccctcgagaacggggcggcgatcgtcgccgctacgggcggctcgaccaacgccgcgctgcatctgcccgccatcgcgaacgaggccggcatcgcattcacgatcgacgatgtcggcgaggtctttgccaggacgccgctgatcggaaatctgcggcccggaggcaaatacacggcgaaggatgtccacgacataggtggcgccgccgtggtgatccaggagttgatcagaaccggtcatatcgacggtaactgcatcaccatcaccggccggacgcttgccgaagaatatggcgcggccaacgcgccggacggtgaggtcgtttacgcggcaagtgcgccgatcatgccggatggcggtgtcgcggtgctgaagggcaacctctgtccggacggtgcggtcatcaaggtcgcaggtttgaagagccagttcttcgagggtgtcgcgcgcgttttcgaagacgaggaggcttgcgtcgcagcggttcgcgaccgcagctacaaggcaggtgaggtcctggtgatccgcaacgaagggccggtcggcggccccggtatgcgcgagatgctcggcgtcaccgcgctgatctacgggcagggcatgggcgaaaaggtggccctgatcaccgacgggcggttctccggcgcgacccgcggcatgtgtatcggctacgtgtcccccgaagcattcgttggcggtccgttggccctcgttcgcgacggcgacaagatccggattgatgctacaaaccggcgtatggatatgctggtcgacgagccggagctcgcggcgcgccgacgtgattggaaaccacgcccgccgcgtcaccgcgcaggcgcgctcgcaaaatatgcgcgactggtcggccaggcgccgggcggagcggttacccatgaggggcccgcagaatggccctggttcgaatga

SEQ ID NO: 126 - protein, 582 aa, Bradyrhizobium japonicum
MKLRCPAAYGTSHVDDANMKKLRSRITTDGLDRAPHRAFMRAMGLDDAAIAKPMVGIVSMKGEQTPCNMTHDFQVAAAKTGIEEAGGTPREFSTVSVSDGISMNHEGMKFSLFSRELIADSIEAVVHGLAYDALIGYGGCDKTLPGVMMGMVRCNVPSIFIYGGSSLPGRVDGRTLTVLDSYEAVGSFMTGEIDSATLERIERACLPTIGACAGQFTANTMGMVSEAMGLTIPNVSMVPGVYAERAQISRRAGRLIMEMLERGGPLPRDIVTRKSLENGAAIVAATGGSTNAALHLPAIANEAGIAFTIDDVGEVFARTPLIGNLRPGGKYTAKDVHDIGGAAVVIQELIRTGHIDGNCITITGRTLAEEYGAANAPDGEVVYAASAPIMPDGGVAVLKGNLCPDGAVIKVAGLKSQFFEGVARVFEDEEACVAAVRDRSYKAGEVLVIRNEGPVGGPGMREMLGVTALIYGQGMGEKVALITDGRFSGATRGMCIGYVSPEAFVGGPLALVRDGDKIRIDATNRRMDMLVDEPELAARRRDWKPRPPRHRAGALAKYARLVGQAPGGAVTHEGPAEWPWFE

SEQ ID NO: 127 - DNA, 1686 bp, Sphingomonas wittichii
atggcgttgaaggacgggaagggcgagacgcttccctcgcggacgatcaccgacgggctcgaccgcgccccgcaccgcgccttcctgcgggcgatggggcatgacgacgtggcgatcggccagcccttcgcgggcatcgtctcgaccggggcgtcggtgacgccctgctcgatgtcgctggcgcctcaggccgaggcggcgaaggccgggctccaggcggcgggggtgacgccgttcgaattctcgacgatcaccgtcgccgacagcatgtcgatgaaccatgccgggatgcgtttcagcctggtctcgcgggagatcatcgccgattcgatcgaggcggtgacgcgggcgcatggctatgacgggctgatcggcttcgcggcctgcgacaagacgttgccgggcacgatgatggggatgatccgggtcaaccgcccgtcggtgttcgtctatggcggcgcggcgctgcccggccgctggcaggggcgcgacatcggcatcgtcgacgtctatgagggcgtcggccgggtctatgccggcgagatggacgaggccgagctgacgcgcctcgaaaaggcgggggtgccgaccgtcggctcctgcgccgggcagttcaccgccaacaccatggcgatggtcgccgagacgctgggcctggcgctgccgcgcagcgcgatgatgccggcggtggcgagcgagcgccgcgcgctggccgaggaatcgggccgcgtgctcggccggctgatccgcgagggcggcccgcgcccgcgcgacctcgtcacccgtcgcagcctcgaaaacgccgccgccaccgttgccgccaccggcggctcgaccaacgccgcgctgcacctgccggcgatcgcacatgaggcaggcatatccttcaccatggaggacatcgccgcgatcttcgaccgcaccccgctgctcgccgacctcaagcccggcggccgcttctgggcgcgcgacctgcacgaggtcggcggcgtgccgaccgtgctgcgggcgatgctggaggcgggcgtgctgcacggcgactgcccgaccatcaccggccggacgatcggcgagatcgccgccgccgcgcccgcgccggacggggaggtggtgcgccccgccgaccggccgatcgcgccgaccggcggggtgatcgtgctgcgcggcagcctcgcccccgacggcgcgatgctcaaggtcgccgggctcaagcgcctgtcgcacgaagggccggcgcgggtgttcgacggcgaggaggcggcggtcgacgcggtccgccggcaggattaccagccgggcgacgtcatcgtcatccgtggcgaggggccgaagggcggccccggcatgcgtgagatgctgggcgtcaccgcgctgatctacggccagggcatgggcgaacaggtcgcgctgctcaccgacggccgcttctcgggcgcgacgcgcggcatgtgcatcggccatgtcggcccggaggcctcggccggcggcccgctcgcgctggtccgggacggcgatcgcatccgcatcgacgcgggccagcgcacgctcgacctgctcgtcgatgccgccgagctggagcgccgccgcgcggcctggaccgcgccggaggctaccgtcacctcgccgaccttgcgcaaatatgcgcggctcgtcgggccggcgcatctcggcgccgtcacccactga

SEQ ID NO: 128 - protein, 561 aa, Sphingomonas wittichii
MALKDGKGETLPSRTITDGLDRAPHRAFLRAMGHDDVAIGQPFAGIVSTGASVTPCSMSLAPQAEAAKAGLQAAGVTPFEFSTITVADSMSMNHAGMRFSLVSREIIADSIEAVTRAHGYDGLIGFAACDKTLPGTMMGMIRVNRPSVFVYGGAALPGRWQGRDIGIVDVYEGVGRVYAGEMDEAELTRLEKAGVPTVGSCAGQFTANTMAMVAETLGLALPRSAMMPAVASERRALAEESGRVLGRLIREGGPRPRDLVTRRSLENAAATVAATGGSTNAALHLPAIAHEAGISFTMEDIAAIFDRTPLLADLKPGGRFWARDLHEVGGVPTVLRAMLEAGVLHGDCPTITGRTIGEIAAAAPAPDGEVVRPADRPIAPTGGVIVLRGSLAPDGAMLKVAGLKRLSHEGPARVFDGEEAAVDAVRRQDYQPGDVIVIRGEGPKGGPGMREMLGVTALIYGQGMGEQVALLTDGRFSGATRGMCIGHVGPEASAGGPLALVRDGDRIRIDAGQRTLDLLVDAAELERRRAAWTAPEATVTSPTLRKYARLVGPAHLGAVTH

SEQ ID NO: 129 - DNA, 1683 bp, Rhodobacterales bacterium
atgaccaaacgcgacacgctcatctcacgcaccatcgtggaggggctcgaccgtgcgccccaccgcgccttcctgcgcgcgatggggcacgacgacacggcactggccagcccgttcgtcggcatcgcacataccgcgagcgaggtgacgccctgcaccatgtcgctcccgccgcagatccagtcggccaagttaggcatcacccgcgaaggaatgaccccgttcgaattcggcacgatcaccgtggccgacagcatgtcgatgaaccatcgcgggatgcgcttttcgctcgtctcgcgtgagatcatcgcggacagcatcgacgcagtggtgcgcggccatgcctatgacgggctgatgaccttcgcctcctgcgacaagacgctgccgggcatgttgatggccatcgcgcgcatcaaccgcccttcggtctttctgtatggcggggccgcgctgccgacgccgtggaacgggcaggacatcggggtggtcgacgtctacgaaggcgtggggcgcgtctatgaggggacatcgagcgaggaagagctcgacgcgatggaacgggtgggcgtgcccactgtcggctcctgcgccgggcagttcacggccaacaccatggcgctcgtggccgaggttctgggcttggcccccctcggtgtcgcctaccttcccgccgtctattccgaacggcaggcactggtgaaacgcgcggcgggtctgttgcgccgcgcggtggacgagaacggcccgctgccctcggacctcatcacgcgcgagtcgctggaaaacgccgtggtcgctgtgggcgcgacgggcgggtcgaccaatgccctcctgcacctgcccgcaatcgcgaacgaggtcgggatcagcttcacgctggacgacatcgcgaaggtgcttgaggacgtgccgctggtcgccgacctgaaacccggcggcgcctactgggcgcgcgacatgcaccacgtgggcagcaccccggcgctcctgcgcgtgttgaagggggcgggcgtgctgcacacggacacgccgagtgtcgagggccggacgctgggtgaactggccgacaccggacctgaagcggacggcaaggtgatccgagccgtgggcaatccggtcacgccgacctcaggcgtggtggtgctcaaggggtcgctcgcccccgaaggggcggtgctcaaggtcgcgggtctcaagcacacagttcacgaaggccccgcgcgggtgttcgagtgcgaggaggatgccgtggccgccgtgcgcaagcgcgaatacgaggcgggcgacgtgattgtgatccgcaacgaaggccccaagggcgggccggggatgcgcgagatgctgggcgtcaccgcgctcctctacggtcagggcatgggcgagaaggtcgcgctcatcaccgacggccgcttctcaggcgcgacgcggggtctgtgcatcggtcacgtcgggcccgaggcggcggcgggtggtcccatcggcctgatccgcaccggcgacatcatccagatcgacgcgggcaaacgggagttgaacgtcaaactatcgacagacgagcttgcccggcgcacccgccccccggtgcccgaggggctggaacccgaaacggcgaccctgcgcaaatacgcggctctcgtcggccccgcgcatctgggcgcgaccacgcaccggaacacctag

SEQ ID NO: 130 - protein, 560 aa, Rhodobacterales bacterium
MTKRDTLISRTIVEGLDRAPHRAFLRAMGHDDTALASPFVGIAHTASEVTPCTMSLPPQIQSAKLGITREGMTPFEFGTITVADSMSMNHRGMRFSLVSREIIADSIDAVVRGHAYDGLMTFASCDKTLPGMLMAIARINRPSVFLYGGAALPTPWNGQDIGVVDVYEGVGRVYEGTSSEEELDAMERVGVPTVGSCAGQFTANTMALVAEVLGLAPLGVAYLPAVYSERQALVKRAAGLLRRAVDENGPLPSDLITRESLENAVVAVGATGGSTNALLHLPAIANEVGISFTLDDIAKVLEDVPLVADLKPGGAYWARDMHHVGSTPALLRVLKGAGVLHTDTPSVEGRTLGELADTGPEADGKVIRAVGNPVTPTSGVVVLKGSLAPEGAVLKVAGLKHTVHEGPARVFECEEDAVAAVRKREYEAGDVIVIRNEGPKGGPGMREMLGVTALLYGQGMGEKVALITDGRFSGATRGLCIGHVGPEAAAGGPIGLIRTGDIIQIDAGKRELNVKLSTDELARRTRPPVPEGLEPETATLRKYAALVGPAHLGATTHRNT

SEQ ID NO: 131 - DNA, 1665 bp, Solibacter usitatus
atgaaactgcagagccataccatcactcagggacgagatcgcgccccggcgcgcgccatgttgaaagcgatcgggtttaccgatgaagatctggccaagccgatcatcgggatcgccaacacctggatcgagaccatgccgtgcaattacaacctgcgtgagctggccggcaaagtgaaggagggcatccgcgccgccggcgggacgccgatggagttcaacaccatcgcgatcagcgacggcgtcaccatgggcacggaaggcatgaaggcctcgctgatcagccgtgaagtaatcgcggattccatcgagctgatggtgcgcggccacatgttcgatggcatcgtcgccatggtggcctgtgacaagaccattcccggcgccgcgatggcgctgctccgcctcaacgtcccgggcgtggtgctttatggcggcaccatcatgccgggccgcttcgagggtcacgacatcacgattcaggacgtgtttgaagccgtcggcgcgcacgcgcgcggcaagatcaccgacgcgcaattgctcgacatcgaagaccacgcctgccccggcgccggagcctgcggcggacagttcacggccaacaccatggccaccgtgatggagctgatcggactctccccgatgggcacggctgccgttccccaggtggacaagcgcaaagacgcagtggcgtaccgctgcggcgaggttattctgaacgccgtgcgcaagaacattctgccgcgcgatatttgcacccgcaaagccttcgagaatgcgattgcaggcgtcgccggaacggccgggtccaccaacgccgtgctgcacctgctggccatggcgcgcgaagccgaagtgccgctgaccatcgatgagtttgaaccggtgctggcgcggacgccggtcttcgtcgatatcaaacccggcggaaagtacatggccgcggacgtggataaggccggcggcattccggtgatcgccaaccgcctgctcgagggcggctacgtggatggctcggcgatcacgatcaccggacgcaccttcgccgaagaagcgaacgaggccaaggaagtcgccgggcagccggtgattcttccgctcgccaaagcgctcaagccgcgcggcggtatcgcgattcttcgcggctctctggcgcccgaaggctgcgtgatcaagctggcaggccacgagaagaaatcgcaccacggtccggcgcgcgtgttcgagcgtgaggaagaggccatggcggccgtgcaggaaggcaagattcgcgagaacgacgtggtagtgatccgctacgaaggtccgcgcggcggccccggcatgcgcgagatgctgggcgtcaccggagccattgtcggcgccggtctgagcgatagcgtagcgctcttgaccgatggccgcttcagcggcgccacgcacggtttcatgatcgcgcacgtggcacccgaggcctttaacggcggcccgatcgcggtcgttcaggaaggcgacatgatcacggtggacgcaacccgcggcgtgcttgaattggatattcccgccggggaactgaagagccggctggccgcatggaagccccgcgaaccccgttacaagaaaggcgtgatcgcgaagtactgcaagctggtttcaagcgcgagcgaaggcgcgatcactcaagcatga

SEQ ID NO: 132 - protein, 554 aa, Solibacter usitatus
MKLQSHTITQGRDRAPARAMLKAIGFTDEDLAKPIIGIANTWIETMPCNYNLRELAGKVKEGIRAAGGTPMEFNTIAISDGVTMGTEGMKASLISREVIADSIELMVRGHMFDGIVAMVACDKTIPGAAMALLRLNVPGVVLYGGTIMPGRFEGHDITIQDVFEAVGAHARGKITDAQLLDIEDHACPGAGACGGQFTANTMATVMELIGLSPMGTAAVPQVDKRKDAVAYRCGEVILNAVRKNILPRDICTRKAFENAIAGVAGTAGSTNAVLHLLAMAREAEVPLTIDEFEPVLARTPVFVDIKPGGKYMAADVDKAGGIPVIANRLLEGGYVDGSAITITGRTFAEEANEAKEVAGQPVILPLAKALKPRGGIAILRGSLAPEGCVIKLAGHEKKSHHGPARVFEREEEAMAAVQEGKIRENDVVVIRYEGPRGGPGMREMLGVTGAIVGAGLSDSVALLTDGRFSGATHGFMIAHVAPEAFNGGPIAVVQEGDMITVDATRGVLELDIPAGELKSRLAAWKPREPRYKKGVIAKYCKLVSSASEGAITQA

SEQ ID NO: 133 - DNA, 1680 bp, Roseiflexus sp.
atgtctagcgacctcaaacgccgcagtcgcaccattaccgatgggcgcacccgcgccggggcgcgcgccatgctcaaggcaatcggcttcaccgacgaagacctggcaaaaccgatcatcggcatcgccaatacctggatcgagacgatgccatgcaacatcaacctgcgcgcgctggcggcgcgggtcaaggaaggcgtgcgcgccgccggcggcacgccgatggagttcaacaccgtcgctatcgccgatggcgtcaccatgggtacggaagggatgaaggcgtcgctgatcagccgcgacctgattgccgactcgatcgaactgatggggcgcgggtatatgttcgacgcgatcatcgcgctggtggcatgcgacaaaacgatccccggagcagcgatgggattgacgcgcctgaacatccccggcttcctgctctacggcggatcgattgctcccggtcactggcgcggcaaagagatcaccatccagcatgtgtacgaagcgatcggtgcagttgccgccggtaagatgaccgacgaagaactgaaagagatcgaagatgccgcgtgccccggtccgggagcatgcggaggtcagtacactgccaacacgatggcaaccgtgatggaaattatcggtctctcgccgatggggacggctgcggtgccggctgccgacccgcgcaaagattcggttggataccgcgccgggcagttgattatggatgtgctgcgacgcgatctgaagccgcgcgatattctgacacgggcggcattcgagaatgcgatcgccagcgtggcgttgaccggcggctcgaccaacgcggtactccatctgctggcgctggcgcgtgaggcgggcgtgccgctaacgctcgacgatttcgacgcgatcagtcgtcgtacaccgctctgctgcgacctgatgccgagcgggaagtactctgccattcacgtcgatcaggcgggcggcattcaggtgattgcgagacgcctggtcgacggcggtttcgcgcacggcgatgcgatcaccgtcactggtcgcaccctggcggaagaggcggcggatgctgtcgaaacgccaggtcaggatgtgatccgtcccctcgataatccgatcaagccgacaggcgggttgctggtgctgcgcggcaatctggcgcccgaaggatcggtggtcaaactgttcggttatgagcgcacctaccaccgcggtccggcgcgcgtcttcgatggcgaagaggcggcaatggccgctatcgtcggcggtgaaattcgaccggacgatattgtgattattcgctatgaaggtccgcgcggcggtcctggcatgcgcgagatgctcggcgttacttccgcgattgtcggcgccggacttgggcagtcggtctcgctcattactgatggacgcttcagcggcgcgacgcgcggtgtgatgatcggacacgtggcgccggaggcggcgcgaggcggaccgcttgcgattgtgcaggagggggatgagatcgagatcaatctcgacgagcgccgtgttgatctgctgctgtcagaagaagagattgccgaccggttgctcgcctggcagccgccagcgccgcgttatgagtggggcgtgatggcgcgctacggtgcgctggtgtcgtcagcgtccgaaggcgccgtgctggtgacaccatga

SEQ ID NO: 134 - protein, 559 aa, Roseiflexus sp.
MSSDLKRRSRTITDGRTRAGARAMLKAIGFTDEDLAKPIIGIANTWIETMPCNINLRALAARVKEGVRAAGGTPMEFNTVAIADGVTMGTEGMKASLISRDLIADSIELMGRGYMFDAIIALVACDKTIPGAAMGLTRLNIPGFLLYGGSIAPGHWRGKEITIQHVYEAIGAVAAGKMTDEELKEIEDAACPGPGACGGQYTANTMATVMEIIGLSPMGTAAVPAADPRKDSVGYRAGQLIMDVLRRDLKPRDILTRAAFENAIASVALTGGSTNAVLHLLALAREAGVPLTLDDFDAISRRTPLCCDLMPSGKYSAIHVDQAGGIQVIARRLVDGGFAHGDAITVTGRTLAEEAADAVETPGQDVIRPLDNPIKPTGGLLVLRGNLAPEGSVVKLFGYERTYHRGPARVFDGEEAAMAAIVGGEIRPDDIVIIRYEGPRGGPGMREMLGVTSAIVGAGLGQSVSLITDGRFSGATRGVMIGHVAPEAARGGPLAIVQEGDEIEINLDERRVDLLLSEEEIADRLLAWQPPAPRYEWGVMARYGALVSSASEGAVLVTP

SEQ ID NO: 135 - DNA, 1701 bp, Rubrobacter xylanophilus
atgcagaccacggacctcaggcgcaagagccgcatcatgttcgaggggcgggaccgggcccccgcccgctcctaccttctgggcatgggctacactcgggaggacctcgagaagcccatcgtgggggtggcccactcctggatcgagaccatgccctgcaactacaaccaccgccggctggccgagaaggtcaaggagggcatccgggcggccgggggcacccccatggagctgaacaccatcgcgatctccgacgggatcacgatgggcacccaggggatgaagacctccctggtctcgcgcgaggtgatcgccgactccatcgagctggtggggcgcggccacatgttcgacgccatggtgatcctggtcggctgcgacaagaccatccccgccggggcgatggcgctggcccggctggacgtccccggcatggtcatctactccggctccatagccccggggcgcttcaggggccgcgacgtgaccatccaggacgtcttcgagggggtgggcgcccacgccgcgggcaagatgagcgacgaggagctgcgggagctggaggagggggcctgcccgggcgcgggggcctgcggcggccagtacaccgccaacaccatggccatagcgctgcagtttttgggcctctcgccggtgggctccgccgacccgcccgccctggacggccgcaaggaggcggtctgcgaggaggcgggccggctggtgatgcgcctgctggagcgggacctcaagccctcggacatcctgagccgcgcggccttcgagaacgccatcgcctccgtggccgctaccgggggctccaccaacgcggtgctccacttcctcgccctcgcccaggaggcgggcatcccgctggacatagaggacttcgaccgggtcagctcccgcacccccatcatcgcggacctgaagcccggcggccgctttacggccgtggacatggaccgcgcagggggctcccggctgctgggcgcgcggatgctggaggcgaacctcgtggacggctcccagcccaccgtcaccgggcgcaccctggccgaggagttcgagggcgcgcgggagcgcccggggcaggaggtgatcctctccgccgagaggtccctcagcgagagcggcggcctggtgatcctcaagggcaacctggcccccgagggctgcgtggtgaaggtcgcgggctacacccgccgccgccacgagggtccggcgcgcgtcttcgactccgaggagcaggcgatggaggcggtccaggccggccggatctcggcgggcgacgtggtggtgatccgctacgaggggccgcgcggcggccccgggatgcgcgagatgctgggggtgaccgccgcgctggtgggccaggggctcggcgagagcgtggcgctgctaaccgacgggcgcttctcaggggccacccgcgggctcatggtgggccacgtcgccccggaggcggcccgcggcggccccatagccgccctgcgcgacggggaccgcatcacgatcgacgtcaccggcaggacgctgagcgtggcgctcaccggcgaggagctgcggaggcgcctggagaactggcgggagcccgagccgcgcttcaggctcggggtgatggccaagtacgccgccctcgtctcctcggcctccgagggggcggtgaccgtcccggactggcagcgccgcgccacctga

SEQ ID NO: 136 - protein, 566 aa, Rubrobacter xylanophilus
MQTTDLRRKSRIMFEGRDRAPARSYLLGMGYTREDLEKPIVGVAHSWIETMPCNYNHRRLAEKVKEGIRAAGGTPMELNTIAISDGITMGTQGMKTSLVSREVIADSIELVGRGHMFDAMVILVGCDKTIPAGAMALARLDVPGMVIYSGSIAPGRFRGRDVTIQDVFEGVGAHAAGKMSDEELRELEEGACPGAGACGGQYTANTMAIALQFLGLSPVGSADPPALDGRKEAVCEEAGRLVMRLLERDLKPSDILSRAAFENAIASVAATGGSTNAVLHFLALAQEAGIPLDIEDFDRVSSRTPIIADLKPGGRFTAVDMDRAGGSRLLGARMLEANLVDGSQPTVTGRTLAEEFEGARERPGQEVILSAERSLSESGGLVILKGNLAPEGCVVKVAGYTRRRHEGPARVFDSEEQAMEAVQAGRISAGDVVVIRYEGPRGGPGMREMLGVTAALVGQGLGESVALLTDGRFSGATRGLMVGHVAPEAARGGPIAALRDGDRITIDVTGRTLSVALTGEELRRRLENWREPEPRFRLGVMAKYAALVSSASEGAVTVPDWQRRAT

SEQ ID NO: 137 - DNA, 1779 bp, Salinispora tropica
gtgacgacccggcctaacccactcttcgtcggcatcgagcgcgccccagcgcgcgcctccatgcgcgccacaggtctgtcgaccgaggacctgaagaagccgatgatcggggtagcgcacagttggatcggcacgatgccgtgcaacctcaaccaccggcggctcgcccaggaggtgatggccggcgtgcgcgccgcaggtggcaccccgatcgagatcaacaccatcgcgatctcggacgtgatcaccatgggcacggagggaatgcggacctcactggtgagccgcgaggtgatcgccgactccatcgagttggtatgccgcggccacggtctcgacggcctggtgaccctggccggctgtgacaagaccatacccggtgcggcgctggcccacgtgcgactcgacatccccggagccgtcatctattccggcacgatgatgccgggcgagcacctcgggcgcgacatcaccctgcaggatgtgtttgaggccgtcggcagcgccaccgccaccggctgcaccgacgagctcgacaagctcgagcgcgcggcctgtcccggtatcggggcctgcgcgggccactacacggccaatacgatggccgtggtgctggagttcctcgggctttccccgttcggctcgatggatccgccggcagtcgacgcccgcaaggacacggtctgccgccaggccggcgagctggtcatgcgggcggtggcagaagggctgcggcccagccggttcctgacgccctcctcgttgcgcaacgccatcgccgccggggtcgccaccggcggctcgacgaacatggtgctccacctgttggcgatcgctcgggaggcgggcatcccgctggacattgacgagttcgaccggatcagctcggtgaccccgatcatcgctgacctgcgtccaaacgggacgtacaccgcggtggacctcgaccgggcgggcggcacccgggtgatcgcccgccacatggtcgacgcgggcctgattgctggcgacgaaagcaccgtcaccggccgcaccgtcgcacacgaggccgcggacgcggccgagacacccggccaacgggtcgtcaccacggtggaggcacccctatcgccttccggtgctctcctgatcttgcggggtaacctagcgcccgatggcagtgtggtgaaggcacccggcgcggtgaccctgcggatgaccggcaccgcattggtgttcaactgcgaggaggaagcgatggccgcggtccagactggccgcgtccggccaggccacgtcgtcgtcatccgctacgagggtccgcgcgggggtccagggatgagggaaatgctcggagtgacctcggcgctcatcggccgcggcctgggcacgtcggtcggtctggtgaccgacggccgtttctcgggcgcgaccaggggactgatggtggggcacgtcgctccggaggcggcggagggcggaccgatcgcggcggtgtgcgacggtgaccggatcaccatcgacctgcagcggcgcgaatgctctgtcgacctggatccgggcgaactggccgcgcggatgcgagactggtcggctccgccaccgcgctacacgatcggcgtcatggccaaatactggtcgacggtctcgtcggcggccgtgggcgccgtgacgaccccgcaccccacccagggcccggcgacagcgtcaggtaaggccgaggagtgccagcaggcgagtgcggtcgagggcgtgatggcggttggcggcggcgatgtcggtgctgccggcggttcgtag

SEQ ID NO: 138 - protein, 592 aa, Salinispora tropica
MTTRPNPLFVGIERAPARASMRATGLSTEDLKKPMIGVAHSWIGTMPCNLNHRRLAQEVMAGVRAAGGTPIEINTIAISDVITMGTEGMRTSLVSREVIADSIELVCRGHGLDGLVTLAGCDKTIPGAALAHVRLDIPGAVIYSGTMMPGEHLGRDITLQDVFEAVGSATATGCTDELDKLERAACPGIGACAGHYTANTMAVVLEFLGLSPFGSMDPPAVDARKDTVCRQAGELVMRAVAEGLRPSRFLTPSSLRNAIAAGVATGGSTNMVLHLLAIAREAGIPLDIDEFDRISSVTPIIADLRPNGTYTAVDLDRAGGTRVIARHMVDAGLIAGDESTVTGRTVAHEAADAAETPGQRVVTTVEAPLSPSGALLILRGNLAPDGSVVKAPGAVTLRMTGTALVFNCEEEAMAAVQTGRVRPGHVVVIRYEGPRGGPGMREMLGVTSALIGRGLGTSVGLVTDGRFSGATRGLMVGHVAPEAAEGGPIAAVCDGDRITIDLQRRECSVDLDPGELAARMRDWSAPPPRYTIGVMAKYWSTVSSAAVGAVTTPHPTQGPATASGKAEECQQASAVEGVMAVGGGDVGAAGGS

SEQ ID NO: 139 - DNA, 1722 bp, Acidobacteria bacterium
atgaccgaaaaatccccaaagccacacaagcgtagcgacgccattaccgaaggtcccaaccgcgccccagcccgcgccatgctgcgcgccgccgggttcaccccggaagaccttcgtaagcccatcatcggcatcgccaacacctggatcgaaatcggtccctgcaacctgcaccttcgtgagctcgccgagcacatcaagcagggcgttcgcgaagccggcggtacgccaatggagttcaacaccgtctccatttctgacggcatcaccatgggctcggaaggcatgaaggcgtcgctggtcagccgcgaggtcatcgccgactccatcgaactcgtcgcgcgcggcaatcttttcgacggcctgatcgccctatcgggatgcgataaaaccatccccgggaccatcatggcgctcgagcgcctcgacatcccgggtctcatgctctatggcggctccatcgcgcccggcaaattccatgctcagaaggtcacgattcaagacgtcttcgaggcagtcggtacgcatgcgcgcggcaaaatgagcgacgctgatctcgaagaactcgaacacaacgcctgtcccggcgccggcgcctgcggtggacaattcaccgctaacaccatgtccatgtgcggcgaattcctcggcatctcgccgatgggcgctaacagcgtcccggcgatgaccgtagagaagcagcaggtcgcacgacgctgcggacacctcgtcatggaactggtccgccgcgacatccgccccagccaaatcatcacgcgcaaggcgatcgaaaacgcaatcgccagcgtcgccgcctccggcgggtcgaccaacgccgttcttcacttgctcgccatcgcgcacgaaatggacgtcgaactgaacatcgaagacttcgacaagatcagttcgcgcacgccactgctctgcgaactcaagcccgctggccgcttcaccgccaccgatcttcatgatgccggcggtattccgctcgtcgcgcaacgcctgctcgaagcgaacctgctgcacgccgacgcactgactgtcaccggtaagaccatcgccgaagaagcgaagcaggcgaaagaaacgccgggccaggaagtggttcgtccgcttaccgatcccatcaaagctaccggcggcctcatgatcctgaaaggcaacctcgcatccgaaggctgcgtggtcaaactcgtcggacacaagaagctcttctttgaaggccccgctcgcgtcttcgagtcggaagaagaagcctttgcgggcgtggaagaccgcaccatccaggcgggcgaagtggtcgtggtccgatatgaaggcccgaagggcggccctggcatgcgcgaaatgcttggcgtgacggcggccatcgccggcaccgaactcgccgagaccgtcgcgctcatcaccgacggacgtttctccggcgctacccgcggcttgagcgtgggccacgttgcgcccgaagccgcgaatggcggcgcgatcgctgtggtacgcaatggcgacatcatcactctcgacgtggaacgccgcgaactgcgcgtccacctcaccgacgcagaactcgaagcgcgcctccgcaactggcgcgcgccggagccacgatacaagcgcggcgtcttcgccaagtatgcgagcaccgtttcgtcggcgtcgttcggggccgttaccggctccaccatcgaaaacaagaccttagccgggagtacgaagtag

SEQ ID NO: 140 - protein, 573 aa, Acidobacteria bacterium
MTEKSPKPHKRSDAITEGPNRAPARAMLRAAGFTPEDLRKPIIGIANTWIEIGPCNLHLRELAEHIKQGVREAGGTPMEFNTVSISDGITMGSEGMKASLVSREVIADSIELVARGNLFDGLIALSGCDKTIPGTIMALERLDIPGLMLYGGSIAPGKFHAQKVTIQDVFEAVGTHARGKMSDADLEELEHNACPGAGACGGQFTANTMSMCGEFLGISPMGANSVPAMTVEKQQVARRCGHLVMELVRRDIRPSQIITRKAIENAIASVAASGGSTNAVLHLLAIAHEMDVELNIEDFDKISSRTPLLCELKPAGRFTATDLHDAGGIPLVAQRLLEANLLHADALTVTGKTIAEEAKQAKETPGQEVVRPLTDPIKATGGLMILKGNLASEGCVVKLVGHKKLFFEGPARVFESEEEAFAGVEDRTIQAGEVVVVRYEGPKGGPGMREMLGVTAAIAGTELAETVALITDGRFSGATRGLSVGHVAPEAANGGAIAVVRNGDIITLDVERRELRVHLTDAELEARLRNWRAPEPRYKRGVFAKYASTVSSASFGAVTGSTIENKTLAGSTK

SEQ ID NO: 141 - DNA, 1668 bp, Thermus thermophilus
atgaggtcggaccagatcaagaagggactcaagcaggcccccgcccgcgccatgctccgggcggtgggggtgggggacgaggacttcggaaggcccttcgtgggggtggtgaacaccttcaccgacgggatgccctgcaacttccacctgcgggagctggcccagcacctcaaggccgggctcagggaggcggggcttttcccctttgagttcggggcccccgccatctccgacgggatcagcatgggcaccccgggcatgcgggcgagcctcgtaagccgcgaggtcatcgccgacagcgtggagctcatcgcccagggctacctctacgacggcatggtggggctttccgcctgcgacaagaccatcccgggcacggccatgggggtgatccgcagcggcgtccccggcatggtcctctacggggggacgatcgcccccggggagtggcaaggccggaagctcaccatcgtggaggtctttgaggcggtggggcaaagggccgcggggaagatcagcgaggaggagcttttggagattgaacgccgggccatccccggccccggggcctgtggggggcagtacaccgccaacaccatggccatggccctcgaggccctgggcctctcccccgtgggctacaacgccatccccgccgtccaccccgaaaaggagcgggccaccaaggaggcggggaaaatcctcgcctgggccatcgcccacgactggaagcccaaggacttcctcacccggaaaagcttcctcaacgccgtcgccgccgtggccgccacgggggggagcaccaacgccgtcctccacctcctcgccctggccaaggaggcgggggtggagctcagcctggacgactttgaccagatctcccgcaagaccccggtgatcgcggacctccgcccttggggcacctacaccgcctgggagctgtatgaagccggggggacggccctcgtcttcaagcggcttctggaggcggggctcctctttggggaggagaagaccctcacgggccgcaccctggcggaggaggtggagcgggcctaccgggaacaagaggggcagaaggtggtcttccccgtggagaaggccctcaagccccacggggggctcgtggtgctcaaggggaacctcgcccctcaaggcgccgtcctcaagctcgcggggacggaacgcacctcctttgagggcccggcccgggtctttgactccgaggaggcggccatggagaaggtcctgaagggggagatccggcccggggacgtggtggtcatccgctacgtgggccccaagggggcgccggggatgcccgagatgctctcggtgacgagcgccatcgtgggggagggcctggggccggaggtggccctcctcaccgacggccgcttctccgggggcacccgcggcctcatgatcggccacatcgcccccgaggccttcgtgggcgggcccatcgccctcctggaagagggggaccgcatccggattgacgtggaaggccgccgcctcgaggtcctcctccccgaggaggagctggaaaggcggagggcccgctggcggccccgaccccccgccttcacccacggcctcttcgcccgctacgccgccctggtgcgccaggcggacgagggggcggtgctggaagacccgctctag

SEQ ID NO: 142 - protein, 555 aa, Thermus thermophilus
MRSDQIKKGLKQAPARAMLRAVGVGDEDFGRPFVGVVNTFTDGMPCNFHLRELAQHLKAGLREAGLFPFEFGAPAISDGISMGTPGMRASLVSREVIADSVELIAQGYLYDGMVGLSACDKTIPGTAMGVIRSGVPGMVLYGGTIAPGEWQGRKLTIVEVFEAVGQRAAGKISEEELLEIERRAIPGPGACGGQYTANTMAMALEALGLSPVGYNAIPAVHPEKERATKEAGKILAWAIAHDWKPKDFLTRKSFLNAVAAVAATGGSTNAVLHLLALAKEAGVELSLDDFDQISRKTPVIADLRPWGTYTAWELYEAGGTALVFKRLLEAGLLFGEEKTLTGRTLAEEVERAYREQEGQKVVFPVEKALKPHGGLVVLKGNLAPQGAVLKLAGTERTSFEGPARVFDSEEAAMEKVLKGEIRPGDVVVIRYVGPKGAPGMPEMLSVTSAIVGEGLGPEVALLTDGRFSGGTRGLMIGHIAPEAFVGGPIALLEEGDRIRIDVEGRRLEVLLPEEELERRRARWRPRPPAFTHGLFARYAALVRQADEGAVLEDPL

SEQ ID NO: 143 - DNA, 1725 bp, Maricaulis maris
atgacccacgacagacgcaaatcttcagacgccatcacagccggcgcggcccgcgccccggcccgggccatgttgcgcgcgaccggcatgacggatggtgatttcgacaagccgatgatcggggtgatcaacacctggaccacggtcacgccctgcaacatgcacctggcggacctggccgcgccagtccgcgaagccgttcgtgaagccggtggccatccggtcgacttcaacacgatcgtcgtgtccgacgggatctcgatgggtaccgaaggcatgcgtgcctcgctgatctcgcgcgaggtgatcaccgactcgattgaactggcgacccggggtcacagcctggatggcgtcgttatcctcgtcggttgtgacaagaccattccggcggccgcgatggcgctggcccgcatggatgtgcccggttgcatcctctacggcggcacgatcatgccgggcaagctgggcgatcaggccctgtccatccaggacgtgttcgaagctgtaggcgcccatgccgcggggaccctggatgatgcaggcctggacaaggtcgaaaaagcggcttgcccgggcgccggcgcctgtggcggccagtttaccgccaatacgatggccatgatcctgaccatgctgggtctgtctccgatgggcgtgaacgacattcccgccccgcaccccgacaagccggaggcggcggctcgctgcggccgactggctgtcgagctggcgaaatccggcaccaccccgcgccgtttcatcaccgaagcctcccttcgcaatgccgttgtcggcgcttccgcctcgggcgggtcgaccaatgccgtcctgcacgtcgccgcaatcgccgccgaagccggcataccgttcgacattgccgagttcgaccgtatctccagcgaagcccccgtcatcaccgacctgaagccgggcgggcgttttctggcccaccacatgttcctggccggcggctcccgcctgttcggtcagcgcctgatcgagggcggcttgctggctgataccccgactgtctccggcaagagcctgcatgaagagtgcgccagcgccgaagagtcactcaatcaacgtgtcatccaatccgttgccaacccggtcaaaccggatggtggtttccgcgtcctgaccggcgacctggcccccgaaggcgcagtcctgaaactgtcgggtcatgcccgcagcgaattttccggaccggcccgggtgttcgaatgcgaggaagacgccttcgccgccgtggaggccaactcggtcaaggctggtgacatcatcatcatccgcaatgagggccccaagggcggccccggaatgcgggaaatgctgggcgtgaccgccgccctggtcggtcagggactggccggcgatgtcgccctgatcaccgatggccgcttttccggcgcctccaagggcttcgtgatcggtcatgtcagccccgaggccgccgatggcggtccgatcggacgggtccgaaatggagacagggtgcgcattgatgtcgccgcccgccggatcgatgtcgatgccgacctgtctgcccgtccgcaatcctcgtccggccggcccgccccgaccggtgttttcgccaaatatgccgcgctggtctcttcggcctcgcgcggcgccaccaccatcatcgcgccgactgccaccaaggcgtcgccgcaaacaaccgacatgcaatccaagcaggagatgcccgcatga

SEQ ID NO: 144 - protein, 574 aa, Maricaulis maris
MTHDRRKSSDAITAGAARAPARAMLRATGMTDGDFDKPMIGVINTWTTVTPCNMHLADLAAPVREAVREAGGHPVDFNTIVVSDGISMGTEGMRASLISREVITDSIELATRGHSLDGVVILVGCDKTIPAAAMALARMDVPGCILYGGTIMPGKLGDQALSIQDVFEAVGAHAAGTLDDAGLDKVEKAACPGAGACGGQFTANTMAMILTMLGLSPMGVNDIPAPHPDKPEAAARCGRLAVELAKSGTTPRRFITEASLRNAVVGASASGGSTNAVLHVAAIAAEAGIPFDIAEFDRISSEAPVITDLKPGGRFLAHHMFLAGGSRLFGQRLIEGGLLADTPTVSGKSLHEECASAEESLNQRVIQSVANPVKPDGGFRVLTGDLAPEGAVLKLSGHARSEFSGPARVFECEEDAFAAVEANSVKAGDIIIIRNEGPKGGPGMREMLGVTAALVGQGLAGDVALITDGRFSGASKGFVIGHVSPEAADGGPIGRVRNGDRVRIDVAARRIDVDADLSARPQSSSGRPAPTGVFAKYAALVSSASRGATTIIAPTATKASPQTTDMQSKQEMPA

SEQ ID NO: 145 - DNA, 1662 bp, Parvularcula bermudensis
atgacccaaaacaaacgaagcgacgccatcaccaagggaccggcccgggccgctgcccgcgccatgctccgcgcgacgggcatgtcggacgccgatttcgacaagccgatggtggggatcatcaacacctacgcctcggtcactccctgcaatatgcatttgcgcgccctgggcgaagacgtccgcgccggtgtcgttgaggggggcggctggccggtcgagttcgggaccatcgtcgtctccgacggcattacgatgggccacgaagggatgcgggccagcctgatgtcgagggaggtgatcgccgactccatcgaactagccgtgcgcggccacgcgctcgatgcggccatcgtgctggtgggatgcgacaagaccattccggccgcagcgatggccctggcacgactcgatatccccgggatcgttttctacggcggcacgatcgcccccggctgtcacaaaggccaggatatcagcattcaggatgccttcgaagctgtcggcgcctatggccttggccggatcgatggcgacgaattgtcggcggtggaacgcgcggcttgccctggtgccggggcgtgcggtggccagttcacggcgaacactatggcgatggccatggcgtttctcggccttgcccccatgggcgccggcgaccccccggccctccatccggacaaaacgatcgaggctcggcgctgtggccaattggtggccgagaatgcccttggcaccaccgcccgcacctatgtctcgcccgagagcctccacaatgccgtctgtgccgttgtcgcctccggcggctccaccaatgcggtgctgcacctcgccgctatcgccgcggaggcgaaggtccccttctcgatcgatctgttcgaccagctttcgaggaccacgccggtgatcgcgaacctcaaaccgggggggcgttacctggcgcaggatctgttcgccgtcgggggcaatcgccggttcggcaaaatgctgatggaagcgggcgcgctgaaagatattcccacgacgagcggacgctctctctttgccgagttggccgaggcgccgccgagcgatgacaccgacgtgctgcgccctgtggacgcgccgctcaagcccaccggcgggctgcgcatcctctatggcgacgtggcgcccgacggcgccgtgctgaaaaccgccggctatggcgacggcgcctttgaggggccggcgcggatcttcgaatgtgaggaggattgcttcgcggcggttcaggccggcaccattgccgagggcgatgtcgtcgtgatccgcaatgaaggccccaaaggcggcccggggatgcgagagatgctcggcgtcacagcggccctcgccggacagggccttgcaggaaaggtcgccttgttgaccgacggccgattttcaggcgccagtcatggcttcgttatcggtcacatctcccccgaggcggcggtgggcggccccatcggcctgttgcaggagggcgaccggatttcgatcgacgccgaagggcggcgtatcgatgccgccatcgactggcaggcccgcaaagagaattataccccaaccccaaaggcgccccagggcggctatttcgacaaatatcgcgcgttggtcggctcggcgagccgcggcgccacaactctccaggaaggataa

SEQ ID NO: 146 - protein, 553 aa, Parvularcula bermudensis
MTQNKRSDAITKGPARAAARAMLRATGMSDADFDKPMVGIINTYASVTPCNMHLRALGEDVRAGVVEGGGWPVEFGTIVVSDGITMGHEGMRASLMSREVIADSIELAVRGHALDAAIVLVGCDKTIPAAAMALARLDIPGIVFYGGTIAPGCHKGQDISIQDAFEAVGAYGLGRIDGDELSAVERAACPGAGACGGQFTANTMAMAMAFLGLAPMGAGDPPALHPDKTIEARRCGQLVAENALGTTARTYVSPESLHNAVCAVVASGGSTNAVLHLAAIAAEAKVPFSIDLFDQLSRTTPVIANLKPGGRYLAQDLFAVGGNRRFGKMLMEAGALKDIPTTSGRSLFAELAEAPPSDDTDVLRPVDAPLKPTGGLRILYGDVAPDGAVLKTAGYGDGAFEGPARIFECEEDCFAAVQAGTIAEGDVVVIRNEGPKGGPGMREMLGVTAALAGQGLAGKVALLTDGRFSGASHGFVIGHISPEAAVGGPIGLLQEGDRISIDAEGRRIDAAIDWQARKENYTPTPKAPQGGYFDKYRALVGSASRGATTLQEG

SEQ ID NO: 147 - DNA, 1683 bp, Oceanicaulis alexandrii
atgaccgataacaaacgcccctcgcacacactgatccaggggccggcccgcgccccggctcgcgccatgcttcgcgcggccggctatgacgatgaccggatggcgaaacccatgatcgccatcgtcaacacctggaccagcgtcaccccgtgcaacatgcaccttcagggtctcgccgatcatgcccgcgccgggatcgaggcggcaggcggcacggcggtggatttcaacaccatcgtcgtcaccgacggcatctccatgggcaccgaaggcatgcgcgccagcctgatgagccgcgattgcgtggcggactccgccgaactcgccgtgcgcggccattgcctggacgccgtgctgttcctggtgggctgcgacaagaccctgcctggcgccgccatggcggcggcgcggctgaacctgcccagcgtcgtgctctatggcggctcgatcatgccgggcaagctgggcgacaaggcggtgacgattcaggacgtgttcgaggccgtcggggcctgcgcggcgggcaagatcagcgaagacgaactcgtcgaagtcgaaaaagccgcctgccccggcgcgggcgcctgcggcggccagttcaccgccaacaccatggcgctggcgctgaccgcgctcggcctgtcgcccatggggctcaacgacattcccgccgttcatcccgacaagcccgaagccgcgcgcaaggccggtcaggccgtggtcgatgcgctgaaggcggatcgcaagccgcgcgacatcatcaccccgacctctctgaaaaacgccgccgtcgcggtgaccgccacggcgggctccacaaacgcggtcctgcatcttctggccattgcccgcgaagccggggtcagccgggatcagttcgacattgatgtgtttgacgccgtgagccggaagactccggtgatcgccgatctcaagcccggcggtcgctatatggcgccggacatggcggctgcgggcggggcacgcctgctgctgcagcgcctgaaagccgcggacatgctggacgatgcgcccaccgtcaccggcaagaccctgtttgaagaagccgagctggccgctgaaacgccgggtcaggacgtgatcctgtcgcccgacaaaccgctcaagaagcgcggcggcttcggcgtgctttatggcgatctcgccccggaaggctgcgtcgccaagctcgcgggtcatgaccgtctgttctttgaaggccccgccaaggtatttgattgcgaggaagactgcttcgccgcggtcaattcgggcgggatcgagaagggcaatgtggtcgtcatccgcaatgaaggccccgccggcgggccgggcatgcgtgaaatgctggccgtcaccgccgccattcaaggcgcaggcctgggcgatgatgtggcgttgatgacggacggccgcttctcgggcgcgacctatggcttcatggtcgggcacgtcgcccccgaagccgcccatggcggacccatcgcctttgtgaagaccggcgatatcatcaccatcgatatcgagaaccgtcgcattgatgtgaaggccgatctcaaggcgcgcatggcccagggcttcaccccgcccgaacccaaataccgcacgggggcgttcgcgaaatacgccaggctcgtccactccgcatcagatggcgcggtgacgagcttcccgttcgactag

SEQ ID NO: 148 - protein, 560 aa, Oceanicaulis alexandrii
MTDNKRPSHTLIQGPARAPARAMLRAAGYDDDRMAKPMIAIVNTWTSVTPCNMHLQGLADHARAGIEAAGGTAVDFNTIVVTDGISMGTEGMRASLMSRDCVADSAELAVRGHCLDAVLFLVGCDKTLPGAAMAAARLNLPSVVLYGGSIMPGKLGDKAVTIQDVFEAVGACAAGKISEDELVEVEKAACPGAGACGGQFTANTMALALTALGLSPMGLNDIPAVHPDKPEAARKAGQAVVDALKADRKPRDIITPTSLKNAAVAVTATAGSTNAVLHLLAIAREAGVSRDQFDIDVFDAVSRKTPVIADLKPGGRYMAPDMAAAGGARLLLQRLKAADMLDDAPTVTGKTLFEEAELAAETPGQDVILSPDKPLKKRGGFGVLYGDLAPEGCVAKLAGHDRLFFEGPAKVFDCEEDCFAAVNSGGIEKGNVVVIRNEGPAGGPGMREMLAVTAAIQGAGLGDDVALMTDGRFSGATYGFMVGHVAPEAAHGGPIAFVKTGDIITIDIENRRIDVKADLKARMAQGFTPPEPKYRTGAFAKYARLVHSASDGAVTSFPFD

SEQ ID NO: 149 - DNA, 1605 bp, Plesiocystis pacifica
atgctgcgcgccacgggcctcgaagacgaggacctcgccaagccgctgatcgccgtggtcaacacctggagcgacgtgaccccctgcaacgtgcacctgcgcgggctcggggaggcggtccgccgcggggtccaagacgctggcggaacgcccttcgagttcaacaccatcgtcgtcagcgacggcatctccatgggcacggagggcatgcgggcgtcgctggtctcgcgggaggtcatcgccgacagcatcgagctcgccgtgcgcgggcacagcctggacgcggtcgtggtcatcgtgggctgcgacaagacgatcccggcggcggccatggccctcgcgcgcctcgatcgtccggggctggtcctctatggcggctcgatcgccaagggccggcaccggggggccgacgtcagcattcaggaggtcttcgaggccgtgggcgcctgcgcggccgggcgcatcgacgcggacgagctcgacgccatcgagcgcagcgcgtgcccgggcgcgggggcctgcgggggccagttcacggccaacaccatggcccaggtgctgaccttgctcgggctctcgcccctgggcgcgaacgacattccggccacgcacccggccaagctcgaggtcgccgaggcttgcgggcgtcaggtcctcgagctgctcgagcgcgagctccggccgagcagcttgctgaaccgggcggccttcgcccgggcgacggcgggggtggccgcgagcaagggctcgaccaacgccgtgctccacatcctcgccatcgcccgggaggccggctgcgacttctcgttgcgcgagctcgacgaggtctgcgcggcgacccccgtgctctgcgacctcaagccctcggggcgctacctggccgtcgacatgagcgaggccggcgggacggccctgctcgcccggcggctgttcgaggccgggctgtgcgaggacggggcgagcgtcgacgggccctcgctccgggccctggtcgccgacgcccccgagcgcgaggggcagcgggtgatccggccggcgagccaggccttcgcgccccggggcgggctcatggcgctgttcggcaacctggcgcccgagggctgcgtgctcaagctgccccccgagctccccgaggtgttcgagggggtcgccagggtgttcgacgacgaggactcggccttcgccgcggtgcaggccggcgccgtcgaggccggcgacgtcgtcgcgatccgctacgaggggccggccggcggcccgggcatgcgcgagatgttggcggtcacggctgccctcgtgggtcggggcctcggcgggcgcgtggcgttgatcaccgacgggcgcttttcgggggcgagccacgggctggtcatcggccacgtcgcccccgaggccgcccggggcggccccctggccaggctccgcgacggcgaccgcgtgcgcatcgacgtcgtcggccagcgcctcgacgtgctcgacgcggacttcgaggcccggcgaagcccggccgcgaaggcgcctcgctacctcaccggcgccctcgccaagttcgccgcgctggtcgactcggccagcgaaggcgccacgacttctcgtccgcagttttga

SEQ ID NO: 150 - protein, 534 aa, Plesiocystis pacifica
MLRATGLEDEDLAKPLIAVVNTWSDVTPCNVHLRGLGEAVRRGVQDAGGTPFEFNTIVVSDGISMGTEGMRASLVSREVIADSIELAVRGHSLDAVVVIVGCDKTIPAAAMALARLDRPGLVLYGGSIAKGRHRGADVSIQEVFEAVGACAAGRIDADELDAIERSACPGAGACGGQFTANTMAQVLTLLGLSPLGANDIPATHPAKLEVAEACGRQVLELLERELRPSSLLNRAAFARATAGVAASKGSTNAVLHILAIAREAGCDFSLRELDEVCAATPVLCDLKPSGRYLAVDMSEAGGTALLARRLFEAGLCEDGASVDGPSLRALVADAPEREGQRVIRPASQAFAPRGGLMALFGNLAPEGCVLKLPPELPEVFEGVARVFDDEDSAFAAVQAGAVEAGDVVAIRYEGPAGGPGMREMLAVTAALVGRGLGGRVALITDGRFSGASHGLVIGHVAPEAARGGPLARLRDGDRVRIDVVGQRLDVLDADFEARRSPAAKAPRYLTGALAKFAALVDSASEGATTSRPQF

SEQ ID NO: 151 - DNA, 1713 bp, Bacillus sp.
ttgggaagagatcttagaataaaaagccatgtaatcagcgaggatgaaaggcgcgcaccaaaccgggcgatgctgcgggcagtagggttcacggatgaagatttcaaaaagccgatgatcggcattgcaagcacatggagcgaagtgactccgtgcaatatacatatcaatgaacttgcattcaaggcgaaggacggtgccagggaagccgggggagctccgcttgtattcaatacgattactgtttctgacggaatctccatgggaacagaggggatgaggtattcccttccgagccgcgacctgattgctgattccattgaaacggtcgttgggggtgaaagcctggacggctttgttgccattggaggctgcgataaaaatatgcccggctgcctgatggccatcgcaaggatgaacctgcctgctgtttttgtgtatgggggcacaatcaagcctggcaagctgcagggacaggatatcgatattgtgtcagtatttgaaggggtaggacagttcaatggtggggccattgataaagctggactcaatgagatcgaatgccatgcatgtccgggggccggctcctgcggcggaatgtacacagccaatacgatggcaagcgctatcgaggcgctgggaatgagccttccgggcagttcctccaatccggcagaaacagatgaaaagcggcaggattgccatgaagcaggaaaggcagtctaccgccttttggagcaggatatcaggccaagggatattcttacgaaggaagcgtttgagaatgcaattactgtcgtgatggctttgggcggttcgacaaatgccatcctccatttgatggccatcgcccattctgctgaagtggatctgtcacttgaggacttcaaccgccttcagaaaacggtcccccatatagccgatttaaagccgagcggaaaatatgtcatgcagaatctccatgaagcaggaggagtcagtgcagttatgaaaatgctgctgagggaagggctgcttcacggcgattgtctgactgtgacgggcaagacgctcgctgaaaatctggaagaagcagaagatctgaaagctggccaaaaggtcatttacccgcttaatgcccctcttcgggaaaacgggccgcttgtagtcctgaaaggcaatcttgccccggaaggcgccgtagcgaaggtatccggcctgaaggtcaccaggcacaccgggcctgccaaggtgtttgatgatgaggagtctgctacagatgctgtcctgaagggtgacattcaggctggtgatgtactggttatcaggtacgaagggccaaaaggcgggcctggcatgccggaaatgctttctatttcgggcatcctcgtaggaaaaggtcttggcgaaagtgtggccctgctgacagacgggcgtttctcgggaggtacccatggccttgtggtaggacatatcgctccggaagcacaggtcggcggaccgattgccctaatacagacaggtgacaggattactattgacagcaccgaacagacacttgaagtggatgtctctcctgctgaactggaagagaggaagaaatcctgggatccgccgccgcttttaacccgcggagccctggctaagtatacaaggctcgtttcctccgcttcaaggggggctgtcactgaccattttgaggaagagcctgctgccaggccgcttaaagtgtag

SEQ ID NO: 152 - protein, 570 aa, Bacillus sp.
MGRDLRIKSHVISEDERRAPNRAMLRAVGFTDEDFKKPMIGIASTWSEVTPCNIHINELAFKAKDGAREAGGAPLVFNTITVSDGISMGTEGMRYSLPSRDLIADSIETVVGGESLDGFVAIGGCDKNMPGCLMAIARMNLPAVFVYGGTIKPGKLQGQDIDIVSVFEGVGQFNGGAIDKAGLNEIECHACPGAGSCGGMYTANTMASAIEALGMSLPGSSSNPAETDEKRQDCHEAGKAVYRLLEQDIRPRDILTKEAFENAITVVMALGGSTNAILHLMAIAHSAEVDLSLEDFNRLQKTVPHIADLKPSGKYVMQNLHEAGGVSAVMKMLLREGLLHGDCLTVTGKTLAENLEEAEDLKAGQKVIYPLNAPLRENGPLVVLKGNLAPEGAVAKVSGLKVTRHTGPAKVFDDEESATDAVLKGDIQAGDVLVIRYEGPKGGPGMPEMLSISGILVGKGLGESVALLTDGRFSGGTHGLVVGHIAPEAQVGGPIALIQTGDRITIDSTEQTLEVDVSPAELEERKKSWDPPPLLTRGALAKYTRLVSSASRGAVTDHFEEEPAARPLKV

SEQ ID NO: 153 - DNA, 1686 bp, Oceanobacillus iheyensis
atgggaaaagatttgcggataaaaagtaaagcatttgacggtactatgcgagctccaaatagggcaatgcttcgtgcggtcggtctgacagatgaagattttaagaagcctatgattggtgtagcaagtacatgggcagaagtaacaccatgtaatatacatttaaatgatttagctcttcttgccaaaaaaggggtccggcactcggatgctgttcctttggtctttaatacgataaccgtatctgatggaatttccatgggaacacaaggtatgaactactcattgccgagtcgagatcttattgctgattcaatcgaaaccgttgttggagcagaaaatttagatggattagtagcaattggagcctgtgacaagaatattccagggtgcttgattgcgattgctaatgcaggagttccctcggtatttgtatatggcggaacaattgccccaggaaatgtggatgggaaagatatagatattgtttcagttttcgaaggagtaggacaacataatgcaggagctattgacgataatcaattaagaaaagtagaatgtaatgcttgtccaggtgcaggagcatgtggtggaatgtataccgccaatacaatggcctctgcagcggaagctttaggaatcagtttaccgggaagctcttctaacccagctgaatcagaagaaaagcagggtgatgtggaggcagctggtgaagcgattaaagatttattagagaaaggtatttatccaaaagatattctaacgaaaaaagcttttgaaaatgcaattacagtagttatggcattgggaggatctacaaatgcgatcttgcatttactagcagtttctcatgccgcagaagtagacttaacgattgatgattttaatcgaatccagaaaaaagtaccgcatttagccgatttaaaaccaagtggacgttttgtaatgcaagaccttcatcgagttggtggggtacaagcagtaatgaaattattgcatgaaaatggatacttacatggcgactgtcttactgtaacaggaaagactatagcagaaaatctagctgaagctcctgctttgaaagaaaatcaacaagtcattatgccgtttgataatccaaaaagggaagatggtcctctgattgtcttaaaggggaatttatcaccaactggtgctgtggcaaaagtatcaggggtgaaagtgaaacgacacacaggtcctgcacgtgtattcaacacagaaaaagaggcaactcaagcaattctggataacaaaattaaagagggagatgtattagttattcgttatgttggaccaaaaggtggtcccggaatgccggagatgttgtctgtttctagtattcttgtaggtaaaggaatgggagaatcggtagctttattgacggatggtagattctctggtggtacacatggtcttgtggtaggtcatataagtccagaggcacaagatggcggaccaattgcatttctgcaagaaggagatatggtgaccatagattctaataaaagagaaatttccatggacgtttcggaagatgaaataaaactacgtcaaggaaaatgggaagcccctgaactacataagaaaggggttcttggaaaatatgcacataatgttacttgctcatccaaaggtgcagtaacagattatttgaaccgagaataa

SEQ ID NO: 154 - protein, 561 aa, Oceanobacillus iheyensis
MGKDLRIKSKAFDGTMRAPNRAMLRAVGLTDEDFKKPMIGVASTWAEVTPCNIHLNDLALLAKKGVRHSDAVPLVFNTITVSDGISMGTQGMNYSLPSRDLIADSIETVVGAENLDGLVAIGACDKNIPGCLIAIANAGVPSVFVYGGTIAPGNVDGKDIDIVSVFEGVGQHNAGAIDDNQLRKVECNACPGAGACGGMYTANTMASAAEALGISLPGSSSNPAESEEKQGDVEAAGEAIKDLLEKGIYPKDILTKKAFENAITVVMALGGSTNAILHLLAVSHAAEVDLTIDDFNRIQKKVPHLADLKPSGRFVMQDLHRVGGVQAVMKLLHENGYLHGDCLTVTGKTIAENLAEAPALKENQQVIMPFDNPKREDGPLIVLKGNLSPTGAVAKVSGVKVKRHTGPARVFNTEKEATQAILDNKIKEGDVLVIRYVGPKGGPGMPEMLSVSSILVGKGMGESVALLTDGRFSGGTHGLVVGHISPEAQDGGPIAFLQEGDMVTIDSNKREISMDVSEDEIKLRQGKWEAPELHKKGVLGKYAHNVTCSSKGAVTDYLNRE

SEQ ID NO: 155 - DNA, 1695 bp, Staphylococcus saprophyticus
ttgactaaagaacacagcgaacaacaaaaagatttacgtattcgcagcaaagtaattagtgaaggtgtcagtcgtacacccaatcgagcttatttacgggcactcggctttgaagatgaagattttcaaaaaccaatgattggtgttgcaagtacttggagtgaagtcacgccatgtaatatgcatattgatggtttagctcgtgcttcaaaacaaggcattagtgaggcaggtgcttcgccacttattttcaataccattacagtatcagatggtatttcaatgggaacagacggtatgcgcttctctttaccaagtcgtgaaattatcgcggattctatagaatcagttgtcagtgctgaaaatttagatgcacttgtcgctattggtggttgtgacaaaaacatgccgggatgtatgattggtatcgctcgtcttaatttaccagctgtctttgtttatggcggcacaatattgcctgggaaattggatggtaaagatttagatgctgtttctgcctttgaaggcgtcggacagtataataatggcgaaatagataaagaggcacttcacaaagtagaatgtgccgcttgtccaggggccggtgcttgtggtggtatgttcactgccaatacgatgtcatctgctattgaggccatgggcatgagtttaccaggaagtgcttcgcatccagcagtttctacaaataaatccaaagacagcagagcagcaggtaaagccgtttataaactattagaaaaaggcatctatccaaaagatattatgactaaagaagcatttgaaaatgcaattactgtagtcatggcacttggaggatctaccaatgcaattttacatttacttgctattgcacatacaatcgaagtcgatttaacacttgatgatttcgaaaaaattcgtaagcgtgtcccacatatcgctgacttgagaccaagtggtaaatatgtcatggcacatcttgatgaagtcggtggtattccagcagttatgaaattattacatgacaaaggcttaatccatggagattgcttgaccgtaactggcaagactgttgctgaaaaccttgaacaacaacctgacctaaccgataataaatctatcattgattttgacaatccaaaacatgctactggaccgcttgttatcttgaaaggaaatcttgccccagaaggcgccgttgcaaaaatctcaggtctgagcgtaacttatatcaaaggacccgcacgcgtatttgattccgaatctaaggctaccaaagccatcttaaatgacgaaatcaaaccaggtgacgtggtcgttattcgatatgctggccctaaaggtgcacctggcatgcctgaaatgctatctgcatcatccattcttgtgggtaagggattaggtgaatctgtagcgttactcacagatggccgtttctctggcggttctcatggtcttgttatcggacacgcagcgccagaatcacaagttggcggtccgatggcattattagaagaaaacgacacgattaccattgacgcagaaaaacttgaaattagttttgatgtatcagacgaagaacttgagcgtcgtaacaaacaatggcaagcaccacctttaaaagccaatcgaggtacgctagctaagtatgctaagcttgtgtcatccgcttcaaaaggagctatcacagactaa

SEQ ID NO: 156 - protein, 564 aa, Staphylococcus saprophyticus
MTKEHSEQQKDLRIRSKVISEGVSRTPNRAYLRALGFEDEDFQKPMIGVASTWSEVTPCNMHIDGLARASKQGISEAGASPLIFNTITVSDGISMGTDGMRFSLPSREIIADSIESVVSAENLDALVAIGGCDKNMPGCMIGIARLNLPAVFVYGGTILPGKLDGKDLDAVSAFEGVGQYNNGEIDKEALHKVECAACPGAGACGGMFTANTMSSAIEAMGMSLPGSASHPAVSTNKSKDSRAAGKAVYKLLEKGIYPKDIMTKEAFENAITVVMALGGSTNAILHLLAIAHTIEVDLTLDDFEKIRKRVPHIADLRPSGKYVMAHLDEVGGIPAVMKLLHDKGLIHGDCLTVTGKTVAENLEQQPDLTDNKSIIDFDNPKHATGPLVILKGNLAPEGAVAKISGLSVTYIKGPARVFDSESKATKAILNDEIKPGDVVVIRYAGPKGAPGMPEMLSASSILVGKGLGESVALLTDGRFSGGSHGLVIGHAAPESQVGGPMALLEENDTITIDAEKLEISFDVSDEELERRNKQWQAPPLKANRGTLAKYAKLVSSASKGAITD

SEQ ID NO: 157 - DNA, 1752 bp, Bacillus selenitireducens
atgatagacgttatatggcatgtgagattatgtacattgacagaaagggtgaatgttgtgagtgagaaggatttgcgtcataaaagtaaagtgatcagtgaaggggtaaaccgggttccgaaccggtcaatgctgcgtgcagtcgggtttaccgatgaggatttcaagaaaccgatgattggggttgcgagtacgtggagtgaggtcaccccttgtaatgtacatattgatgccttggcaagagatgccaagctcggagcggcagaaggcggcggagcgccgatgatcttcaatacgatcatggtcgctgacgggattgcgatggggcatgaaggcatgagctattccctgccgtcaagggaagtcatcgccgattccattgaaacggttgtcggagcagaagccctcgacgccgtcgtcgccattggcggttgtgacaaaacaacgccgggctgtctcatttccatgggacggatgaatgtaccgggcgtctatgtgtatggcggtacgatcaaaccggggaaactcgatggcaaggacatcgacatcgtcaactccttcgaggcagtcggtcagtaccagagcggcaagcttgatgaggaaggccttcataaagtggaatgttctgcctgccctggaccgggttcctgcggcgggatgtacacggcaaatacaatggccgcagcggcagaagcgctcggcatgagtattccaggctcatcatcgacgcctgcagtggatgattataagcatcaggagtgcaggcaggccggcgatctgacggttcagcttttggaaaaagacatcaagccccgtgatattatgacgaagaaggcgtttgagaatgccattaccgtcgtcatggccctcggcggctcaacaaatgccttcctgcatcttcttgcgattgcgagaagcgttgacgtcgacttgacgtatgatgactttgaacgggtccgcaagaacgtcccgcatattgccgatctgaagccaagcggtcagtatgtcatggaagacctcttccaggcagggggcgtgcctggcgtgatgaagctgcttcttgaagccggcctcctacatggcgactgcatgacggtaactggcaagacgattgccgagaaccttgcagctgcggaaccgctgaaagaaggacaaaaagtgatttttccgcttgataagccgattaagccaagcggtccattgattgtcatgaaagggaatctggcccctgaaggcggggttgccaagatgagcggtcagtcgatcagtcattttgaaggtacgatcaaagtgtatgacagtgaggccgatgcgacgaaggccattgaagcgggagagatcgttgagggggatgtcctcgtcatccgctatgtgggtccaaaaggcggtccgggtatgccggagatgctctcgatcacggcgatgatcgtaggtcgaggcttgaacggtaaagtcgcactgatgacagatggccgattctccggcggttcacacggctttgttatcggtcatattgcaccggaagccgcagtaggcgggccgattgcgctgatcaagaatggtgacaaggtcacgatcgatgcggatacgcaggagatcaatctgcatattgatgaagcggagtttgagaagcggaaacaggaatggcagccgaagccgccgcggtttacgtacggcgtgttgaagaaatatgccaaactcgtttcgtcttcagcggaaggcgcaattacagacggtaaagaagccgattga

SEQ ID NO: 158 - protein, 583 aa, Bacillus selenitireducens
MIDVIWHVRLCTLTERVNVVSEKDLRHKSKVISEGVNRVPNRSMLRAVGFTDEDFKKPMIGVASTWSEVTPCNVHIDALARDAKLGAAEGGGAPMIFNTIMVADGIAMGHEGMSYSLPSREVIADSIETVVGAEALDAVVAIGGCDKTTPGCLISMGRMNVPGVYVYGGTIKPGKLDGKDIDIVNSFEAVGQYQSGKLDEEGLHKVECSACPGPGSCGGMYTANTMAAAAEALGMSIPGSSSTPAVDDYKHQECRQAGDLTVQLLEKDIKPRDIMTKKAFENAITVVMALGGSTNAFLHLLAIARSVDVDLTYDDFERVRKNVPHIADLKPSGQYVMEDLFQAGGVPGVMKLLLEAGLLHGDCMTVTGKTIAENLAAAEPLKEGQKVIFPLDKPIKPSGPLIVMKGNLAPEGGVAKMSGQSISHFEGTIKVYDSEADATKAIEAGEIVEGDVLVIRYVGPKGGPGMPEMLSITAMIVGRGLNGKVALMTDGRFSGGSHGFVIGHIAPEAAVGGPIALIKNGDKVTIDADTQEINLHIDEAEFEKRKQEWQPKPPRFTYGVLKKYAKLVSSSAEGAITDGKEAD

SEQ ID NO: 159 - DNA, 1704 bp, Streptococcus pneumoniae
atgactgaattagataaacgtcaccgcagtagcatttatgacagcatggttaaatcacctaaccgtgctatgcttcgtgcgactggtatgacagataaggactttgaaacaccgattgtgggagtgatttcgacttgggcggaaaatacaccatgtaacattcacttgcatgatttcgggaaactggctaaagaaggtgtcaaatctgcaggcgcttggcctgtacagtttggaaccattaccgtagcagacgggatcgctatgggaacgcctggtatgcgtttctctctaacatctcgtgacatcatcgcggactccatcgaggcggctatgagtggtcacaacgtggatgcctttgtcgctatcggtggctgtgacaagaacatgcctggatctatgattgctattgctaatatggatatcccagctattttcgcctatggtggaactattgcaccgggaaatcttgatggtaaagatatcgacttggtttctgtctttgaaggtatcggaaaatggaaccacggtgacatgacagctgaggacgtgaaacgtcttgaatgtaatgcctgccctggccctggtggctgtggtggtatgtatactgctaataccatggcaactgctatcgaagttctagggatgagtttgccagggtcatcctctcacccagctgaatcagctgataagaaagaagatatcgaagcagcaggacgtgctgttgttaagatgttggaacttggtctcaaaccatcagatatcttgactcgtgaagcctttgaagatgctattactgtaacgatggctctcggtggttctacaaacgccactcttcacttgctcgccattgcccatgccgcaaatgttgacttgtcacttgaggacttcaatacgattcaagaacgtgtgcctcacttggccgacttgaaaccatctggtcagtatgtcttccaagacctctacgaagtcggtggtgtccctgcggttatgaagtacttgttggcaaatggtttccttcacggagatcgcatcacatgtactggtaagactgtagctgaaaacttggctgactttgcagacttgactccaggccaaaaagttatcatgccacttgaaaatccaaaacgtgcggatggtccgcttatcatcttgaacgggaaccttgctcctgacggtgcagttgccaaggtatcaggtgttaaagtgcgtcgtcacgttgggccagctaaggtctttgactcagaagaagatgcgattcaggccgttctgacagatgaaatcgttgatggcgatgtagtcgttgttcgttttgttggacctaaaggtggtcctggtatgcctgagatgctgtcactttcttcaatgattgttggtaaaggtcagggagataaggtggccctcttgacggacggacgtttctctggtggtacttatggtctggttgttggacatatcgctcctgaagctcaggatggtggaccaattgcctatctccgtaccggcgatatcgttacggttgaccaagataccaaagaaatttccatggccgtatccgaagaagaacttgaaaaacgcaaggcagaaacaaccttgccaccactttacagccgtggtgtcctcggtaaatatgcccatatcgtatcatctgcttcacgcggagccgtgacagacttctggaatatggacaagtcaggtaaaaaataa

SEQ ID NO: 160 - protein, 567 aa, Streptococcus pneumoniae
MTELDKRHRSSIYDSMVKSPNRAMLRATGMTDKDFETPIVGVISTWAENTPCNIHLHDFGKLAKEGVKSAGAWPVQFGTITVADGIAMGTPGMRFSLTSRDIIADSIEAAMSGHNVDAFVAIGGCDKNMPGSMIAIANMDIPAIFAYGGTIAPGNLDGKDIDLVSVFEGIGKWNHGDMTAEDVKRLECNACPGPGGCGGMYTANTMATAIEVLGMSLPGSSSHPAESADKKEDIEAAGRAVVKMLELGLKPSDILTREAFEDAITVTMALGGSTNATLHLLAIAHAANVDLSLEDFNTIQERVPHLADLKPSGQYVFQDLYEVGGVPAVMKYLLANGFLHGDRITCTGKTVAENLADFADLTPGQKVIMPLENPKRADGPLIILNGNLAPDGAVAKVSGVKVRRHVGPAKVFDSEEDAIQAVLTDEIVDGDVVVVRFVGPKGGPGMPEMLSLSSMIVGKGQGDKVALLTDGRFSGGTYGLVVGHIAPEAQDGGPIAYLRTGDIVTVDQDTKEISMAVSEEELEKRKAETTLPPLYSRGVLGKYAHIVSSASRGAVTDFWNMDKSGKK

SEQ ID NO: 161 - DNA, 1719 bp, Streptococcus sanguinis
atgaaagggaaagctatgacagataaggatattcgtcacagaagtaagatttatgacagtatggttaaatctcctaaccgtgccatgcttcgcgcgacggggatgactgataaagattttgaaacgcctattgttggggtgatttccacttgggcggaaaatacaccctgtaacatccatttgcatgacttgggcaagctagccaaggaaggtatcaaagcagagggcgcttggcctgttcagtacgggactattacggttgcggacggaattgccatgggaacgccgggtatgcgcttctctctgacctcacgcgatatcatcgcagactccatcgaggctgccatgggcgggcataatgtggatgctttcgtagctatcgggggctgtgataaaaatatgccaggctccatgattgccattgccaatatggatattcctgctgtctttgcctacggcggaacgattgcgccagggaagctggacggtaaggacattgacttggtttctgtctttgaaggaatcgggaaatggaaccatggtgatttgacggctgaggaagtacgacgcattgagtgtaatgcctgccctggccctggtggctgtggtggtatgtatacggccaatactatggcgacggctattgaagttctgggtatgagcctgccaggctcctcttctcaccctgctgagtctaaagacaagcaagaggatatcgaagcagctggtcgtgctgttgtgaaaatgctgaaaatggggctgaagccgtctgacatcttgacacgtgaagcctttgaagatgcaatcacggtgaccatggctctgggtggttctactaatgctaccctgcacttgctggccatggcgcacgcggccaatgttgagctgacgcttgatgactttaatgtcattcaagagaaggtaccgcatttggctgacttgaaaccatctggtcagtatgtcttccaagacctttatgaggttggtggggtaccggctgtgatgaaatatctcttggcgaacggcttcctgcatggtgatcgcatcacttgtacaggtaagactgttgcagagaatctggtagaatttgctgatctgacaccaggtcaaaaggtcattatgccgcttgaaaatccaaaacgtgcggacggtccgctcattatcttgcatggtaatctggctccagatggtgctgttgccaaggtttctggtgttaaagtgcgccgtcacgttggaccggctaaggtctttgactcagaagaagcagctattgatgctgtactggccgatgaagtggtcgatggcgatgtggtcgtggttcgctatgttggaccaaagggtggccctggtatgccagaaatgctgtcactttcttctatcatcgtagggaaaggtcaaggggacaaggtggcacttctaactgacggccgcttctcaggcggtacttacggcttggttgtcggacacattgctccggaagctcaggatggtggcccgattgcctatcttcgtacaggcgatatggtcacggttgaccaagataccaaggaaatctctatggcagtctctgacgaagagctggcgaaacgtaaggcagaaacgactattccaccgctttatagtcgcggggtacttggtaaatatgctcacatggtatcgtctgccgctaaaggtgctgttactgacttctggaaaccagaagaaacaggtaagaaatag

SEQ ID NO: 162 - protein, 572 aa, Streptococcus sanguinis
MKGKAMTDKDIRHRSKIYDSMVKSPNRAMLRATGMTDKDFETPIVGVISTWAENTPCNIHLHDLGKLAKEGIKAEGAWPVQYGTITVADGIAMGTPGMRFSLTSRDIIADSIEAAMGGHNVDAFVAIGGCDKNMPGSMIAIANMDIPAVFAYGGTIAPGKLDGKDIDLVSVFEGIGKWNHGDLTAEEVRRIECNACPGPGGCGGMYTANTMATAIEVLGMSLPGSSSHPAESKDKQEDIEAAGRAVVKMLKMGLKPSDILTREAFEDAITVTMALGGSTNATLHLLAMAHAANVELTLDDFNVIQEKVPHLADLKPSGQYVFQDLYEVGGVPAVMKYLLANGFLHGDRITCTGKTVAENLVEFADLTPGQKVIMPLENPKRADGPLIILHGNLAPDGAVAKVSGVKVRRHVGPAKVFDSEEAAIDAVLADEVVDGDVVVVRYVGPKGGPGMPEMLSLSSIIVGKGQGDKVALLTDGRFSGGTYGLVVGHIAPEAQDGGPIAYLRTGDMVTVDQDTKEISMAVSDEELAKRKAETTIPPLYSRGVLGKYAHMVSSAAKGAVTDFWKPEETGKK

SEQ ID NO: 163 - DNA, 1719 bp, Streptococcus thermophilus
atggaggaaaacatcgtgtctgaaaataacatgaaacaccgttcttctgtctacgatagcatggttaaatcacctaaccgtgctatgcttcgtgcgactgggatgacggatgatagttttgaaaagcctattgttggggttatctcaacttgggctgagaacacgccatgtaatatccacttgcacggttttggtcaaattgccaaagagggtgtcaaagatgcgggtgcttggccagttcaatttggtacaattaccgttgcagatggtattgccatggggacaccagggatgcgtttctcattgacatctcgtgatattattgctgactcaatcgaagctgctatgggtggtcacaatgtcgatgcctttgttgctattggtggctgtgataagaacatgccaggttcaatgattgctattgccaacatggatattccagctatttttgcttacggtggtacgattgcaccgggtaatcttaacggtaaggatatcgacttggtttctgttttcgaaggtatcggtaaatggaaccacggagatatgactgccgaagaggttaaaaatcttgaatgtaatgcttgccctggccctggtggttgtggtggtatgtatactgctaacacaatggcaacagcaattgaggttatggggatgagccttccaggatcatcatctcaccctgcagaatcagctgagaagaaggctgatatcgaagaagcaggtcgtgcagttgtaaaaatgctagaaatgggacttaagccatcagatatcttgacacgtgaagcctttgaagatgccatcacagttacaatggcgcttggtggttcaacaaatgccactcttcacttgcttgctatcgctcatgcggctaacgttgatttaacgcttgaagacttcaacgatttccaagagcgcgtgcctcacttggctgacttgaagccttcaggtcaatatgtcttccaagacctttacaatgttggtggtgtgccagccgttatgaaatatcttcttaagaatggttttcttcacggtgatcgtatcacgtgtactggtaagactgttgcagaaaatttggaagctttcgatgatttgacaccaggtcaaaaagttatcatgccacttgaaaatcctaaacgtgccgatggtccattgattatcttgaaaggtaacttggccccagaaggtgctgttgccaaagtatcaggtgttaaagtgcgtaacattactggtcctgctaaagtatttgactcagaagaagatgccatcgaggcagttctttctgacgaaatcgttgacggcgatgtagttgttgtacgttttgtaggtcctaagggtggtcctggtatgccagaaatgttgtcattgtcatcaatgattgttggtaaaggacaaggagacaaggttgccctcttgactgatggacgtttctcaggtggtacttacggacttgttgtaggtcatattgctcctgaagctcaagttggtggaccgattgcctacctccgtacaggtgatatggttacagttgaccaggataccaaagaaatcactatgcatgtaccagacgaagagttggcgaaacgtaaagcagaaactgagttaccaccactttatagccgtggtgtcctcggtaagtatgctcacatcgtttcatcagcatcacgtggtgcggttactgacttctggaatatggataaatcaggtaaagcttaa

SEQ ID NO: 164 - protein, 572 aa, Streptococcus thermophilus
MEENIVSENNMKHRSSVYDSMVKSPNRAMLRATGMTDDSFEKPIVGVISTWAENTPCNIHLHGFGQIAKEGVKDAGAWPVQFGTITVADGIAMGTPGMRFSLTSRDIIADSIEAAMGGHNVDAFVAIGGCDKNMPGSMIAIANMDIPAIFAYGGTIAPGNLNGKDIDLVSVFEGIGKWNHGDMTAEEVKNLECNACPGPGGCGGMYTANTMATAIEVMGMSLPGSSSHPAESAEKKADIEEAGRAVVKMLEMGLKPSDILTREAFEDAITVTMALGGSTNATLHLLAIAHAANVDLTLEDFNDFQERVPHLADLKPSGQYVFQDLYNVGGVPAVMKYLLKNGFLHGDRITCTGKTVAENLEAFDDLTPGQKVIMPLENPKRADGPLIILKGNLAPEGAVAKVSGVKVRNITGPAKVFDSEEDAIEAVLSDEIVDGDVVVVRFVGPKGGPGMPEMLSLSSMIVGKGQGDKVALLTDGRFSGGTYGLVVGHIAPEAQVGGPIAYLRTGDMVTVDQDTKEITMHVPDEELAKRKAETELPPLYSRGVLGKYAHIVSSASRGAVTDFWNMDKSGKA

SEQ ID NO: 165 - DNA, 1716 bp, Streptococcus suis
atgaccgatacaaacaaacttaaagactttcgacatcgcagctctgtttacgattcgatggtcaaatcgcccaaccgtgctatgttaagagcaacaggaatgaccgacgatagctttgaaaagcctattgttggggttatttcgacatgggctgaaaacacaccctgtaacatccaccttcatgactttggaaaattagccaaagaaggtgtcaaggaagcaggtgcctggcctgtccaatacggtaccatcaccgttgcagacggaatcgctatgggaactcctggtatgcgcttctccttgacttcacgtgatatcattgcagattctattgaggcagctatgggagggcacaacgtggatgcctttgtcgcaatcggtggctgtgataaaaacatgcctggttctatgattgctatcgccaatatggatatccctgctgtttttgcctacggcggaaccattgcgccaggtaatctcaatggtaaagacatcgacttggtatccgtttttgaaggaatcggaaaatggaacaacggtgacttgaccgctgaagaggttcgtcaaatcgagtgtaacgcttgccctggacctggtggttgcggtggtatgtacactgccaataccatggcgacagccattgaggtaatgggcatgtctattcctggctcttcttctcaccctgctgaatctcctgagaagaaggctgatattgaagaagctggtcgtgctgttgtacgcatgctagaacttggcatcaaaccatctgacattatgacgcgtgaagcctttgaagatgccattacagtcacaatggctctgggcggctcaaccaacgctactctgcacttgctggccattgcccatgctgccaacgttgatttgaccttggaagatttcaacgatttccaagagcgtgtgcctcatttggccgacttaaaaccatctggtaaatatgttttccaagacctctataatgtcggcggtgtccctgcggttatgaaatacttgctcaaaaacggcttccttcatggcgaccgcatcacatgtacaggtaaaaccgttgctgaaaacctaaagaattttgcagacttgactccaggtcaagatgtcatcatgccacttgaaaatccaaaacgagcggatggacctctgattatcttgaaaggtaaccttgctcctgaaggtgccgttgccaaggtttctggtgtgaaagtccgcaaccatacaggtccagccaaggtctttgattctgaagaagaagctatcgaagcagtcttgactgacgaaatcgtagatggcgatgtagtcgttgtccgctatgttggaccaaaaggcggtcctggtatgcctgaaatgctgtccctttcttctatgattgtcggaaaaggccaaggtgacaaggtagcccttctaacagacggtcgtttctctggtggtacctatggactggttgtgggacacatcgcacctgaagctcaggatggtgggccaattgcctacctccgtactggtgatttggtgacggttgatcaagataccaaagaaatcaccatgcacgtttctgaccaagaaatcgaagaacgcaagaaaacaactgttattccaccactctactctcgtggcgttctcggaaaatacgcccacactgtatcctctgcctctaaaggagccgttaccgacttctggagaccagaacgtacggggaaaaaataa

SEQ ID NO: 166 - protein, 571 aa, Streptococcus suis
MTDTNKLKDFRHRSSVYDSMVKSPNRAMLRATGMTDDSFEKPIVGVISTWAENTPCNIHLHDFGKLAKEGVKEAGAWPVQYGTITVADGIAMGTPGMRFSLTSRDIIADSIEAAMGGHNVDAFVAIGGCDKNMPGSMIAIANMDIPAVFAYGGTIAPGNLNGKDIDLVSVFEGIGKWNNGDLTAEEVRQIECNACPGPGGCGGMYTANTMATAIEVMGMSIPGSSSHPAESPEKKADIEEAGRAVVRMLELGIKPSDIMTREAFEDAITVTMALGGSTNATLHLLAIAHAANVDLTLEDFNDFQERVPHLADLKPSGKYVFQDLYNVGGVPAVMKYLLKNGFLHGDRITCTGKTVAENLKNFADLTPGQDVIMPLENPKRADGPLIILKGNLAPEGAVAKVSGVKVRNHTGPAKVFDSEEEAIEAVLTDEIVDGDVVVVRYVGPKGGPGMPEMLSLSSMIVGKGQGDKVALLTDGRFSGGTYGLVVGHIAPEAQDGGPIAYLRTGDLVTVDQDTKEITMHVSDQEIEERKKTTVIPPLYSRGVLGKYAHTVSSASKGAVTDFWRPERTGKK

SEQ ID NO: 167 - DNA, 1716 bp, Streptococcus mutans
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 168 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 169 - DNA, 1683 bp, Leptospira borgpetersenii
atgagcgatatattaaaaaaaagaagttcgatgactacggacggagataaccgcgcgcccaatcgagcgatgcttcgcgcggtcggctttacggacgaagatttccacaaacctatgatcggaatcgcttccacatggagcgaagtgacgccttgtaatattcatatcaataagttggccgaaaaagtcaaagagggcgttcgtacggcgggaggagttcctcaaatttacggaaccatcacggtttccgacggaattacgatgggtcacgaagggatgcatttttcacttccctccagagaagtgattgcggattcaatcgaaatcgtttccaacgcgatgagacacgacggagtgatcgcgatcggaggttgtgataagaacatgcccggatgtctcatggctctttgcagaatcgatgctccttctattttcgtttacggggggaccattcttccggggcattgcgacggtcaagacgtggatatcgtttccatcttcgaagctgttggtaaatttaatgcaggtaaaatttcaagagaagaattcattcgaatcgagcagaacgcgtgtcccggcgcaggaagttgcggggggatgtataccgcaaatacgatgtcctccgcgatagaagctcttgggatgagtctgccaggttcggcttccatgcccgcggtgagttctagaaaatcggaggattgttacgaggcgggaaaagctctcatcaatctcattcaaaagggagtcactccgaagcgaattcttaccaaaaaagcttttgagaacgcgatcaccgtagtgcttgtgttaggcggttcaaccaatgcggtccttcatttgattgcgatcgcgaaagagattggtgtggatcttactctcgaagactttgatcgaatcagtaaaaaaactcctcaccttgcggatttgaaaccgggtggtagatacgccatgaccgatctcgacaaagtgggcggggttcatggtgtgatgaagtatcttttgaaagaaggaatgcttcatggtgattgtcttacggttacgggaaaaacaattgcagaaaatctaatggatatgcccgatctcgttccaaaccagacgatcgtccgtaaaaaatcggaggcgctccatccttccggtcctcttgtgattttgaaaggaaaccttgccccggaaggtgcggttgctaaaatttccggtttgaagaaaatttccatcacgggcccggcgaaagtgttcgaatccgaagacgattgtttcaatgcgatcatgacggatcaaattaaaccgggcgacgtgattatcattcgttacgaaggtcccaaaggtggtcccgggatgagagagatgctcgcggtaacttcggcgcttgtcggaaaaggtttgggagaagacgtgggtctgatgacagacggtcgattcagtggaggaacgcacggtctcgtagtcggtcatatttctcccgaagcatttgatggaggtccgattgcgatcgttcaaaatggggatgcggttactatcgattccggtaaaaatttgctccaagttgaaatttctcaggaagaaattcagaaacggctaaaaaattggaaaccgattgaaccgagatataaatccggggttcttgcgaaatacgcaaaactggttcaatcggcgactaacggagcgattacgaatctgctttga

SEQ ID NO: 170 - protein, 560 aa, Leptospira borgpetersenii
MSDILKKRSSMTTDGDNRAPNRAMLRAVGFTDEDFHKPMIGIASTWSEVTPCNIHINKLAEKVKEGVRTAGGVPQIYGTITVSDGITMGHEGMHFSLPSREVIADSIEIVSNAMRHDGVIAIGGCDKNMPGCLMALCRIDAPSIFVYGGTILPGHCDGQDVDIVSIFEAVGKFNAGKISREEFIRIEQNACPGAGSCGGMYTANTMSSAIEALGMSLPGSASMPAVSSRKSEDCYEAGKALINLIQKGVTPKRILTKKAFENAITVVLVLGGSTNAVLHLIAIAKEIGVDLTLEDFDRISKKTPHLADLKPGGRYAMTDLDKVGGVHGVMKYLLKEGMLHGDCLTVTGKTIAENLMDMPDLVPNQTIVRKKSEALHPSGPLVILKGNLAPEGAVAKISGLKKISITGPAKVFESEDDCFNAIMTDQIKPGDVIIIRYEGPKGGPGMREMLAVTSALVGKGLGEDVGLMTDGRFSGGTHGLVVGHISPEAFDGGPIAIVQNGDAVTIDSGKNLLQVEISQEEIQKRLKNWKPIEPRYKSGVLAKYAKLVQSATNGAITNLL

SEQ ID NO: 171 - DNA, 1665 bp, Candidatus Vesicomyosocius okutanii
atgtgcatcccaagaaaatattcctcacaagttgttgatggatttgaacgcgcaccaagtcgtgctatgctttaccccattggttttaaaaaagatgattttagcaaaccccaggttggtatagcaagcacttggtcaatggtaacaccatgtaatatgcatattaataaattagctgataaagccgaaaaagggataaataacgcaggtggtaaaggtgttatctttaacaccattaccatatcagatggtatttctatgggctctgaaggtatgaaatattccttagtatcacgcgaagtcattgccgattcaattgaaacagttgttggttgtcaagggtttgatggtgtggttgctattggtgggtgtgataaaaatatgcctggttgtattattggcttagcacgtcttaatcgccctagtatttttgtttatggcggtactattcaaccgggtaaaaatcgtacagatgtggtaagtgttttcgaagcagttggccgattttctaaccatgaaattgatgaaatagaactagaaaatattgaaaaaacagccgttactggagcaggttcttgtggtggtatgtacactgctaatactatggcatcagcaattgaagcattaggtatgagtttacccaactccagcgcacaaaatgctatatcagatgataaaaataatgattgtatccaagctggagaagctattcttactttattaaataaagacattaaaccccgtgatataatgactatgaaagcattcgaaaatgccatcactgtaattattgcattgggtggctcaaccaatgctgtattgcatttaattgccatggcaaatgccgctgaggttaatctcaaaattgatgattttactcgcattggtaaaaaagtacctgttattgctgaccttaaaccatcaggtaaatatatgatgagtgaattggttgaaattgggggtacattaccactaatgaaaatgctacttgatgcaggactattacatggggattgcatgacagtaacaggaaaaactttagctaaaaatttaaaaaatgttcaatcatatgctgattcccaagaaattattagagcattagataacccaataaagaaagattcacaccttagaattttgcgtggtaaccttgcaattaatggtgctgtggcaaagattactggtaaagaaggttcaagtttcaaaggtacagctaaatgtttttctcatgaagaaggagcgcttaaggctattttaaatgaccaaataaaagcaggtaatgttatcgttattcgttacgaggggcctgttggtggtcctggtatgcgtgaaatgcttgctcctacttctgcagttatggggaaaggattgggtggtaaaattgcacttattactgatgggcgcttctctggtggtacacatggttttgtagtcgggcatatcactcctgaagcctttaaaggtggagtgctagcagtggttgaagatggtgatgaaattataattgatgcacaaaataacgttttagaactattagttgatcaagctattattgataaacgcttatctaaatggacgcaacctaaaccaaactacactaaaggtgtattagcaaaatttgcaaaactagctaaatctgcttctgaaggtgcagttactgattaa

SEQ ID NO: 172 - protein, 554 aa, Candidatus Vesicomyosocius okutanii
MCIPRKYSSQVVDGFERAPSRAMLYPIGFKKDDFSKPQVGIASTWSMVTPCNMHINKLADKAEKGINNAGGKGVIFNTITISDGISMGSEGMKYSLVSREVIADSIETVVGCQGFDGVVAIGGCDKNMPGCIIGLARLNRPSIFVYGGTIQPGKNRTDVVSVFEAVGRFSNHEIDEIELENIEKTAVTGAGSCGGMYTANTMASAIEALGMSLPNSSAQNAISDDKNNDCIQAGEAILTLLNKDIKPRDIMTMKAFENAITVIIALGGSTNAVLHLIAMANAAEVNLKIDDFTRIGKKVPVIADLKPSGKYMMSELVEIGGTLPLMKMLLDAGLLHGDCMTVTGKTLAKNLKNVQSYADSQEIIRALDNPIKKDSHLRILRGNLAINGAVAKITGKEGSSFKGTAKCFSHEEGALKAILNDQIKAGNVIVIRYEGPVGGPGMREMLAPTSAVMGKGLGGKIALITDGRFSGGTHGFVVGHITPEAFKGGVLAVVEDGDEIIIDAQNNVLELLVDQAIIDKRLSKWTQPKPNYTKGVLAKFAKLAKSASEGAVTD

SEQ ID NO: 173 - DNA, 1680 bp, Candidatus Ruthia magnifica
atgcgaagaaaaattatgtacaacccaagaaaatactcctcacaagttgttgacggatttgaacgcgcgccaagtcgtgccatgctttatccagttggatttacaaaagaggattttaacaagcctcaagtcggcatagcaagcacttggtcaatggtaacaccgtgtaatatgcacattaataaattggctgatgagacattaaaaggggtaaatgccacaggtggtaaagccattatttttaacactattactatttcagatggtatttctatgggctctgaaggcatgaagtactctttagtctcacgtgaagttattgccgattcaattgaaactgtggttggttgtcaaggttttgatggtgtggttgcaattggtggttgcgataaaaacatgcctggttgtattattggtttggtacgtcttaatcgccctagtatttttgtttatggaggcacaatccagccgggtaaaaatcatacagatgtggtgagtgtttttgaagcagttggccaatttgccaatcatacaattgatgcgattgaattagaaaatattgaaaaaatagctatccctggtccaggctcttgtggcggtatgtatacggctaacactatggcatcagcgattgaagcattaggtatgagcctgccaaattctagtgcgcaagatgctatttcagatgataaaaataacgactgtgttcaagctggacaggccgtccttaatttattaaacaaagacattaaacctcgtgacattatgaccatgaaggcatttgaaaatgctattaccgtaattattgcattgggtggctcaactaatgctgtattgcatttaattgccatggcaagtgctgctgaggttaatcttaaaattgatgactttactcgcattggccaaaaagtacccgttattgctgaccttaaaccatcaggcaaatacatgatgagtgaattggttaaaattggcggtacattgccgctaatgaaaatgttacttgatgcaggattattgcacggagactgcctaacagtaacaggaaaaactctagctgaaaatttagaaaatgttaagccatacgctgattctcaagaaatcattagagcactagacaacccaataaaaaaagattcacaccttagaattttacgtggcaatcttgcaaccgatggtgctgttgcaaaaattactggcaaagaaggtttgagtttcaaaggcaatgcgaaatgtttttctcgtgaagaggatgcgcttgaagccattttaaataatcaaataataacaggtgatgtgattgttattcgctatgaaggccctgtcggaggtcctggtatgcgcgaaatgctcgcccctacttctgcagttatgggcaaaggcttaggtgataaagttgcgttaattaccgatggtcgtttttctggcggtacacatggttttgtagtcggtcacatcacccctgaagcctttgaaggtggtgtactggctgtggttaaagatggagatgaaatcttaattgatgcacaaaacaacgttttagagttattagttgagcaagcaattatcgataaacgtctatataattggacacaacccaaaccaaactacaccaaaggtgtattggctaaatttgcaaagttggctaaatctgcctctgaaggtgcagtgactgattag

SEQ ID NO: 174 - protein, 559 aa, Candidatus Ruthia magnifica
MRRKIMYNPRKYSSQVVDGFERAPSRAMLYPVGFTKEDFNKPQVGIASTWSMVTPCNMHINKLADETLKGVNATGGKAIIFNTITISDGISMGSEGMKYSLVSREVIADSIETVVGCQGFDGVVAIGGCDKNMPGCIIGLVRLNRPSIFVYGGTIQPGKNHTDVVSVFEAVGQFANHTIDAIELENIEKIAIPGPGSCGGMYTANTMASAIEALGMSLPNSSAQDAISDDKNNDCVQAGQAVLNLLNKDIKPRDIMTMKAFENAITVIIALGGSTNAVLHLIAMASAAEVNLKIDDFTRIGQKVPVIADLKPSGKYMMSELVKIGGTLPLMKMLLDAGLLHGDCLTVTGKTLAENLENVKPYADSQEIIRALDNPIKKDSHLRILRGNLATDGAVAKITGKEGLSFKGNAKCFSREEDALEAILNNQIITGDVIVIRYEGPVGGPGMREMLAPTSAVMGKGLGDKVALITDGRFSGGTHGFVVGHITPEAFEGGVLAVVKDGDEILIDAQNNVLELLVEQAIIDKRLYNWTQPKPNYTKGVLAKFAKLAKSASEGAVTD

SEQ ID NO: 175 - DNA, 1689 bp, Methylococcus capsulatus
atgaccgacaagcacccccgtccccattcgtcccaggtcgtcgacggcatggagcgcgccccgagccgcgcgatgctgcacgccgtcggcttcgccgatgccgacttcgccaaaccgcagatcggcatcgcttccacctgggcgatggtgacgccgtgcaacatgcacatcaacaagctcgccgaggacgcagcacgcggcgtcgacggcggcggcggcaaggcagtgatcttcaacaccatcaccatttccgacggcatctcgatgggcaccgaaggaatgaaatactccctcgtgtcgcgggaagtcatcgccgactcgatcgaaaccgtggtggcctgtcagggttatgacggcgtggtcgccatcggcggctgcgacaagaacatgcccggctgcctgatcgccctcgcccgcctcaaccgtccggcggtgttcgtctatggcggcaccatcctgccgggctgccacgacggcaagaagctggacgtggtgtcggtgttcgaagcggtcggcgcccgcgccaaccaccgcatcgacgatgccgaactgcacgccatcgaatccaatgccatccccggtccgggctcctgcggtggcatgtataccgccaacaccatggcctccgccatcgaggcattagggatgagcctgccgggcagttcggcccaggtggccatttcccgcgccaaggaactggattgcgagcgggccggcgcgcaggtcctcaagctcctggacctggggctcaaaccccgcgacatcatgaccaagaaggcgttcgagaacgccatcacggtggtgatcgccctgggcggctccaccaacgccgtgctgcacctcctggccatggccaacgcctgcggcgtcgacctgaagctcgacgatttcacccgcatcgggcgcaaagtgccgatgctggcggatctgaaacccagcggcagatactccatggccgaactggtggaaatcggcggcatccagccgctgatgaagaccttgctggacgcgggactcctgcacggcgactgcatgaccgtaaccggcaagaccctggaagaaaacctggccgacgcgcccgactacccggccggacaagacatgatccggtcgctggacaaccccatcaaaaaggacagccatctggtgatcctcaagggcaacctggcgccggaaggcgcggtcgccaagatcaccggcaaggaaggactgagcttcaccggcaccgcccgcgtattcgactgcgaggaagcggcgctcacggccatcctcgacggcacgatcgtgaaaggcgacgtcatcgtcatccgctatgaaggccccaagggcggccccggcatgcgcgagatgctctcgccgacctcggcggtcatgggcaagggattgggcaaggaggtcgccctcatcaccgacggccgcttttccggcggcacccacggcttcgtggtcggccacatcacgccggaagcctacaccggcggccccctggcgatcgtccgggacggcgataccatcaccatcgacgccgagacccgcgaattgagcctgcacgtcaccgacgatgaaatcggccggcgcctggcgcagtggactcaaccggcgccgcgctacaccaagggcgtgctggccaaatacgccaggttggtgagcccggcctcggaaggcgccgtcaccgacgacggcctctga

SEQ ID NO: 176 - protein, 562 aa, Methylococcus capsulatus
MTDKHPRPHSSQVVDGMERAPSRAMLHAVGFADADFAKPQIGIASTWAMVTPCNMHINKLAEDAARGVDGGGGKAVIFNTITISDGISMGTEGMKYSLVSREVIADSIETVVACQGYDGVVAIGGCDKNMPGCLIALARLNRPAVFVYGGTILPGCHDGKKLDVVSVFEAVGARANHRIDDAELHAIESNAIPGPGSCGGMYTANTMASAIEALGMSLPGSSAQVAISRAKELDCERAGAQVLKLLDLGLKPRDIMTKKAFENAITVVIALGGSTNAVLHLLAMANACGVDLKLDDFTRIGRKVPMLADLKPSGRYSMAELVEIGGIQPLMKTLLDAGLLHGDCMTVTGKTLEENLADAPDYPAGQDMIRSLDNPIKKDSHLVILKGNLAPEGAVAKITGKEGLSFTGTARVFDCEEAALTAILDGTIVKGDVIVIRYEGPKGGPGMREMLSPTSAVMGKGLGKEVALITDGRFSGGTHGFVVGHITPEAYTGGPLAIVRDGDTITIDAETRELSLHVTDDEIGRRLAQWTQPAPRYTKGVLAKYARLVSPASEGAVTDDGL

SEQ ID NO: 177 - DNA, 1662 bp, unknown
  uncultured marine bacterium EB80_02D08
atgacaaatagaaaatattcaaaagaacttttagatggaccaaatcaagcagcatcaagatcaatgcttagaggagtaggatttacatctgatgatttcaagaagccacttgtaggaattgcatcaactggggcaaaagttactccatgcaatatgcatattaatcagctgtcagaaattgttgagcattcagttgataattccggaggtaaaggagtgctattcaatactattacagtttctgatggtatatcaatgggaacacaaggcatgaaatactcactcgtttcaagagaagtcatagcagattctatagaaactgttgtgggctgtcttggttatgatggtgttatagcagttggtggatgtgataaaaatatgcccggatgtattatcggcatggcaaggcttaatagaccttccatatttatatatggtggctcaatcagacccagtgaagaaaataccgattatgtaactgtatgtgaaaagactggtgagttttctaaaggcgatctagacgaatctcaactaattcatgtagaaaaaatatctgtaaagggtcctggatcctgtggaggtatgtatacagccaatactatggcatctgctattgaggcattgggtatgagtcttcctggaagtagcagtcaagatgctgtctcaaatgataaagaagatgattgcataaaagctggtatagcgatcatgggcttattagaaaaagacatcaagccttcagacattatgacaaaaaaagcttttgagaattctataactatggtgattgctttaggcggttccacaaatgcagtacttcatttacttgctatggctgatgcaattggagttgatttaacgcttgatgactttacaagaatcggtaaaaagacgccagtcttagcagatttaaagccttttggctctcattatatgtctgagcttaatgcaaatggagggatacagccgctaatgaaaacccttttagataaaggcttacttcatggtgattgtcttactgttacagggaaaacactctcagaaaatctttctttagttaaaccttatgaattacatcaagatattatcaaggagtttgatagtccaataaaagctaatagtcatctcaggatactatatggaaatttagctgaagaaggagcggttgcaaaaataacaggaaaagagggaacttcttttgaaggtagcgctcgagtttttaattcagaggaagaaggcgttgaggctattttatcaaaatcaattaaacctggcgacgttgtagtaataagatatgagggaccaaaaggtggtcctgggatgagagaaatgttgaagcctacttcggcaatcatgggccaaggcctgggagataaagttgcatttattaccgatggtcgtttttcaggaggtactcatggttttgttgttggacacattacaccagaagcggcagatggtgggctaatagcaattattgaagatggtgattcaatactaattgatgcaaactcggataaactagtactgaatatctctgatgatgagatttcaactagacttagtaaatgggttaaccctaaaacgcctccaagaaaaggtgttctagcaaaatttgcacgaaatgttaaatcagcaagtcttggagcggtgacagattaa

SEQ ID NO: 178 - protein, 553 aa, unknown
  uncultured marine bacterium EB80_02D08
MTNRKYSKELLDGPNQAASRSMLRGVGFTSDDFKKPLVGIASTGAKVTPCNMHINQLSEIVEHSVDNSGGKGVLFNTITVSDGISMGTQGMKYSLVSREVIADSIETVVGCLGYDGVIAVGGCDKNMPGCIIGMARLNRPSIFIYGGSIRPSEENTDYVTVCEKTGEFSKGDLDESQLIHVEKISVKGPGSCGGMYTANTMASAIEALGMSLPGSSSQDAVSNDKEDDCIKAGIAIMGLLEKDIKPSDIMTKKAFENSITMVIALGGSTNAVLHLLAMADAIGVDLTLDDFTRIGKKTPVLADLKPFGSHYMSELNANGGIQPLMKTLLDKGLLHGDCLTVTGKTLSENLSLVKPYELHQDIIKEFDSPIKANSHLRILYGNLAEEGAVAKITGKEGTSFEGSARVFNSEEEGVEAILSKSIKPGDVVVIRYEGPKGGPGMREMLKPTSAIMGQGLGDKVAFITDGRFSGGTHGFVVGHITPEAADGGLIAIIEDGDSILIDANSDKLVLNISDDEISTRLSKWVNPKTPPRKGVLAKFARNVKSASLGAVTD

SEQ ID NO: 179 - DNA, 1599 bp, unknown
  uncultured marine gamma proteobacterium EBAC31A08
atgcttagaggagtaggtttcacatctgaggmtttcacaaaaccatttgttgggattgcttccacaggagcaaaagtaaccccatgcaatatgcacataaatgcactttcagagatcgttgagaaatcagttgatagttcaggaggaaagggtgttctttttaatactattactgtttccgatggaatttctatgggtacacagggtatgaaatattctcttgtttctcgagaggtaattgcagattcaatagaaactgttgtgggatgtcttggttatgatggagttattgctgtcggtggttgtgataaaaatatgcctggatgcattattggaatggcaagattaaatagaccatcaatatttatatatggtggttctatcaaacctagtaaagaaaataccgactatgttactgtttgtgagaaaactggagagtactcaaaaggcgatcttaaagaatctgaattaattcatgtagaaaaaatttccgtaaaagggcctggatcttgtgggggaatgtatacggcaaatactatggcttctgcgattgaagctctaggcatgagtcttcctggaagcagcagtcaagatgcaatttcacacgacaaagaagatgattgttttaaggctggcgaagcgataatgaatttattagaaaaagatattaagccttcagatattatgactaagaatgcttttgagaatgctataacaatggtaattgctctaggaggttcaactaatgcagttctgcatttattggccatggcgcattcaataggggttgatttagagctagatgactttacaagaataggaaaaaaaacacccgttatggcagatcttaagccctttggttctcattatatgtctgaactcaatgctaatggcggtattcagccactaatgaaaactttgcttgagaagggattactacacggcaattgtcttaccgttaccggtcagacgcttgctgaaaatctttctggaataaaaccttacgagcctgatcaagagataattaaatcatttgataatccaattaaatcaaatagccatcttagaattctgtatggcaacttagcgaaagatggtgcagttgcaaaaattacgggtaaagaaggaacttcctttgaaggaagtgctcgtgtatttgattcagaagaagaaggggttaaagcaatcctatctaaatctataaaagctggagatgttgttgtaattagatatgaagggccaaaaggaggtccaggcatgagagaaatgctaaaaccaacatctgccataatgggtcaaggtcttggcgatcaggtagcttttataacagacggtcgtttttcaggaggcactcatggatttgttgttgggcacattactccagaggctgcagatggcggcttaattgcaataattaaagatggcgactctatattaattgatgcagattctgataagttaattcttaatatttctgaggatgaaatttcaaatagactaagtagatgggtaaacccaaaaacgcctcccaaaaaaggagtcttagcaaaatttgcaaaaagtgttaaatcagctagtcttggagcggtaacagattaa

SEQ ID NO: 180 - protein, 532 aa, unknown
  uncultured marine gamma proteobacterium EBAC31A08
  misc_feature (11)..(11): Xaa can be any naturally occurring amino acid
MLRGVGFTSEXFTKPFVGIASTGAKVTPCNMHINALSEIVEKSVDSSGGKGVLFNTITVSDGISMGTQGMKYSLVSREVIADSIETVVGCLGYDGVIAVGGCDKNMPGCIIGMARLNRPSIFIYGGSIKPSKENTDYVTVCEKTGEYSKGDLKESELIHVEKISVKGPGSCGGMYTANTMASAIEALGMSLPGSSSQDAISHDKEDDCFKAGEAIMNLLEKDIKPSDIMTKNAFENAITMVIALGGSTNAVLHLLAMAHSIGVDLELDDFTRIGKKTPVMADLKPFGSHYMSELNANGGIQPLMKTLLEKGLLHGNCLTVTGQTLAENLSGIKPYEPDQEIIKSFDNPIKSNSHLRILYGNLAKDGAVAKITGKEGTSFEGSARVFDSEEEGVKAILSKSIKAGDVVVIRYEGPKGGPGMREMLKPTSAIMGQGLGDQVAFITDGRFSGGTHGFVVGHITPEAADGGLIAIIKDGDSILIDADSDKLILNISEDEISNRLSRWVNPKTPPKKGVLAKFAKSVKSASLGAVTD

SEQ ID NO: 181 - DNA, 1659 bp, unknown
  uncultured marine gamma proteobacterium EBAC20E09
atgagctctagaaaatattcaaaagaccttgttgatggcccaaatcaagctgcatcaagatcaatgctgcgtggggttggatttactactgaagatttttcaaaatcttttgtaggcattgcatcaacaggtgcaaaagttacaccgtgtaatatgcatatcaataaacttgcagaagttgttgagaattcggtgaatgtatctggaggtaaaggagtactttttaatactattactgtatcagacggcatatcaatgggaactcaaggcatgaaatattctcttgtatcaagagaggttatagctgattcaattgaaacagttgttggttgtttaggttatgatggcttaatcacaattggtggctgtgataagaacatgcctggctgtttgataggcatggcaagattgaaccgaccatccattttcatttatggggggtcaattaagccaagtaatgaaaaaaccgactatgtcacagtatcagaaaaggttggtgaattctccaaaggcgacattgatgaaaaagaactcattcattatgaaaaaatttcagtagaaggcccaggatcatgcggtggtatgtataccgcaaatacaatggcttcagctatcgaagctttaggaatgagtttaccaggcagcagcagtcaagatgcagtttcaaaatctaaaaatgaagattgcatttctgcaggaatagccataatgaatttgcttgaaaaagatttaaaaccctctgacattatgacaaaggaggcttttgaaaatgcaattacagttgttattgcattaggtggatcgacaaatgctgttcttcatttattagctatggctcatgccgtaggtgtcgaacttcaattggatgattttacaaaaattggaaaactcactccggtacttgcagacctcaaaccatttggtaatcattttatgtctgagttaaatgcaaacggtggaatacagccactaatgaaaagtttattagataaaggaatgctgcatggaaattgtttgacggttactggtaattcattagaagaaaatttaaaagatatagagccgtataaagatgaaaaaataataaaaagcttagataatccaattaaatctgatagtcatttaagagtgttatatgggaacttagctaaggatggcgctgttgcaaaaattacaggaaaggagggcttttcatttgaaggcaaagccaaagtatttaactcggaagaagatggagttcaggcaatccttgcaaaaaaaattgttccaggtgatgtagttgtaattagatatgagggaccaaaaggtggtccgggcatgagagaaatgttaaagccaacatctgcgatcatggggttaggcttaggagataaagttgcttttataactgacggtagattttctggaggaactcatggatttgttgtgggccatgtatctccagaggcagcagatggaggcctaattgctttaatcaaagatggagacaatatcttgatagatgcagaaaatgatgaattaatactaaaggttgatcaagacgaaattgatttaagaaagaagaactggaaaaatcctactaatcctcctaaaaaaggagttcttgcaaagtatgctgcaagtgtaaaatctgccagcttaggagcaattactgattaa

SEQ ID NO: 182 - protein, 552 aa, unknown
  uncultured marine gamma proteobacterium EBAC20E09
MSSRKYSKDLVDGPNQAASRSMLRGVGFTTEDFSKSFVGIASTGAKVTPCNMHINKLAEVVENSVNVSGGKGVLFNTITVSDGISMGTQGMKYSLVSREVIADSIETVVGCLGYDGLITIGGCDKNMPGCLIGMARLNRPSIFIYGGSIKPSNEKTDYVTVSEKVGEFSKGDIDEKELIHYEKISVEGPGSCGGMYTANTMASAIEALGMSLPGSSSQDAVSKSKNEDCISAGIAIMNLLEKDLKPSDIMTKEAFENAITVVIALGGSTNAVLHLLAMAHAVGVELQLDDFTKIGKLTPVLADLKPFGNHFMSELNANGGIQPLMKSLLDKGMLHGNCLTVTGNSLEENLKDIEPYKDEKIIKSLDNPIKSDSHLRVLYGNLAKDGAVAKITGKEGFSFEGKAKVFNSEEDGVQAILAKKIVPGDVVVIRYEGPKGGPGMREMLKPTSAIMGLGLGDKVAFITDGRFSGGTHGFVVGHVSPEAADGGLIALIKDGDNILIDAENDELILKVDQDEIDLRKKNWKNPTNPPKKGVLAKYAASVKSASLGAITD

SEQ ID NO: 183 - DNA, 1659 bp, unknown
  uncultured gamma proteobacterium eBACHOT4E07
atgagctctagaaaatattcaaaggaattagttgatggtccaaatcaggccgcatctcgttctatgcttcgaggtgtaggatttacatctgaggactttacaaagccatttgttggaattgcatcaactggagccaaagttacaccatgtaatatgcatatcaatcaattatcagaattggtagaagactcaataaatgcatctggtggcaaaggtgttttatttaatacaattactgtttctgatggcatttcaatgggaacgcaaggaatgaaatattctcttgtttcaagagaagttattgctgactcaattgaaactgttgtaggttgccttggatatgatggattaattgcaattggtggatgtgataagaacatgcctggatgtcttattggtatggcaagattaaatagaccgtcaatatttatttatggtggatctataaaaccaagtaatgagaatacggactatgtcactgtctcagaaaaagttggagaattctcaaagggctctataaatgaagatgagctaattcattatgaaaagatatcagttgatggaccaggctcatgtggcggaatgtatacagcaaatacaatggcatctgccatagaggcattaggaatgagtttgccaggtagcagtagccaagatgcaacatctaaatcaaagaacgctgattgtgtgaatgctggatcggcaatcatgaatttactagataaagatattaaaccttctgacattatgacaagagaagcatttgaaaatgctataactgttgtaatagctctaggaggatcaacaaatgccgttcttcatttattggccatggctcattcaattggagttgaactttgcttagatgactttacttcaattggaaagaaaacacctgtattagcggacctaaaaccctttggaaaacactatatgtctgagcttaatgcaaatggaggaattcagcccttaatgaaaactcttttagacaaaggacttcttcatggtcaatgtatgacagttacaggcaataccttagaagaaaatttaaaagacataaaagcatatgagacgagtgaaataattaaagattttaataatccaatcaaaaaagatagtcatcttagaattttatacggcaaccttgctaaagatggcgcggttgcaaaaattacaggtaaagaaggaacatcttttgaaggaaaagcaaaagtatttaattcagaagaagagggcgtaagtgcgattctatcaaatcagattaatgatggtgatgtaatcgtaataaggtatgagggtccaaagggtgggcctggcatgagagaaatgctaaaacctacttctgcaatcatgggattaggactaggagataaaataggatttattacagatggaagattttcaggtggcacccatggttttgtagttggacatgtttctccagaagcagctgagggtggtttaatagcattagttgaagatggagatactatacttattgatgcagaaagtgatcagcttgttctaaaagttgatgatgatgaaattaaaagaagacaatcaatttggaaaaatccaaacagtaaaccaaaaaaaggagtacttgctaagtatgctgagagcgtaaaatctgcaagcctgggagctataactgattaa

SEQ ID NO: 184 - protein, 552 aa, unknown
  uncultured gamma proteobacterium eBACHOT4E07
MSSRKYSKELVDGPNQAASRSMLRGVGFTSEDFTKPFVGIASTGAKVTPCNMHINQLSELVEDSINASGGKGVLFNTITVSDGISMGTQGMKYSLVSREVIADSIETVVGCLGYDGLIAIGGCDKNMPGCLIGMARLNRPSIFIYGGSIKPSNENTDYVTVSEKVGEFSKGSINEDELIHYEKISVDGPGSCGGMYTANTMASAIEALGMSLPGSSSQDATSKSKNADCVNAGSAIMNLLDKDIKPSDIMTREAFENAITVVIALGGSTNAVLHLLAMAHSIGVELCLDDFTSIGKKTPVLADLKPFGKHYMSELNANGGIQPLMKTLLDKGLLHGQCMTVTGNTLEENLKDIKAYETSEIIKDFNNPIKKDSHLRILYGNLAKDGAVAKITGKEGTSFEGKAKVFNSEEEGVSAILSNQINDGDVIVIRYEGPKGGPGMREMLKPTSAIMGLGLGDKIGFITDGRFSGGTHGFVVGHVSPEAAEGGLIALVEDGDTILIDAESDQLVLKVDDDEIKRRQSIWKNPNSKPKKGVLAKYAESVKSASLGAITD

SEQ ID NO: 185 - DNA, 1686 bp, Alcanivorax borkumensis
atgagtgactcaaagggcgatccgcgtcgccgccattcagcaaaggtcgtggacggccccggtaaatccgccagccgggccatgctgcgggcggtggggtttaccgatgaggattttcataaaccccaggtgggcattgcttctacttggagtcaggtgacgccgtgcaatagccatatcggtgagctcgccgaaaaagcctgcgctggagccgatgcggccggcggcaaaggggtaattttcaataccatcaccatctccgatggcatcgccaatggtaccgaagggatgaagtattcgttggtctcccgcgaggtgattgccgattccattgaaaccgtggcggcttgtgaaggctttgacggcctggtagctcttggtggctgcgataagaacatgcccggttgcctaatgggcatggcgcggctgaatcgccccagcgtctttgtctacggcggcaccatcatgcccggcaagggccacacggatattgtttctgtgttcgaagccatgggagcccattcccgcggcgacatggacaaaatcgaactcaagcagatagaagaaactgccattcccgggcccggtgcttgcggcggcatgtacacggccaacactatggcctcggctattgaagcgctgggcatgagcctgccgggcagctccgcacagaatgcggtgtcggaagagaagcgtgatgattgccagcgcgccggcgaagcagtgttggcgctactggaacaggacatcaagccctcggacatcatgacgcgggctgcatttgagaacgccatcactgtggtgatcgccctgggcggttccaccaatgcggtgctgcacctgatcgccatggcgcgcaccgtgggggtgccgctgtcgctggatgactttaccgagatcggcaggcgggtgccggtgctggcggacctgcgccccagtggccattacatgatgagcgagttggtggccatcggcggtattcagccgttgatgaaggtgctgttggaggcgggtttgctgcagggtgattgcctgacggtcaccggccgtaccttggctgagaacctggcggatgtcagtccttatccactggatcagacgatcatcgcgccactgtctgcgccgctgaaagcagaaagtcacctgcgcatcctttatggcaatttggcgccggatggcgcagtggccaagatcaccggcaaggaaggcacccacttttccggcccggcccgggtgttcggttcggaagaagaagcgcagcagcggatcaatgatgggactgtggtgtccggggacgtggtggtgatccgctatgaaggcccccgcggcggcccaggcatgcgtgaaatgctcacccccacctctgccatcatggggcgcggcctgggtgacgaggtggcgctgattaccgatggtcgcttttccggcggcagccatggtttcgtggtaggccacgtgaccccagaagctttcgatggtggtccgctggcattattggaaaacggtgaccaaattaccattgatgccgaagccaacaccctggtcgtggcgctgtctgatgcggagttggcgcgccgccgtgctaactggcaacagccagcaccacgctatacccgtggtgtgctggccaaatacgcacggctggtgggttcggccagcgaaggcgcgctgacggacttaggttaa

SEQ ID NO: 186 - protein, 561 aa, Alcanivorax borkumensis
MSDSKGDPRRRHSAKVVDGPGKSASRAMLRAVGFTDEDFHKPQVGIASTWSQVTPCNSHIGELAEKACAGADAAGGKGVIFNTITISDGIANGTEGMKYSLVSREVIADSIETVAACEGFDGLVALGGCDKNMPGCLMGMARLNRPSVFVYGGTIMPGKGHTDIVSVFEAMGAHSRGDMDKIELKQIEETAIPGPGACGGMYTANTMASAIEALGMSLPGSSAQNAVSEEKRDDCQRAGEAVLALLEQDIKPSDIMTRAAFENAITVVIALGGSTNAVLHLIAMARTVGVPLSLDDFTEIGRRVPVLADLRPSGHYMMSELVAIGGIQPLMKVLLEAGLLQGDCLTVTGRTLAENLADVSPYPLDQTIIAPLSAPLKAESHLRILYGNLAPDGAVAKITGKEGTHFSGPARVFGSEEEAQQRINDGTVVSGDVVVIRYEGPRGGPGMREMLTPTSAIMGRGLGDEVALITDGRFSGGSHGFVVGHVTPEAFDGGPLALLENGDQITIDAEANTLVVALSDAELARRRANWQQPAPRYTRGVLAKYARLVGSASEGALTDLG

SEQ ID NO: 187 - DNA, 1713 bp, Chromohalobacter salexigens
atgagccagcaggactcccccgccaacgccgatcaccgtcgccgccattcctccatcgtggtcgacggccccggcaaggccgccagtcgcgccatgctgcgtgccgtcggtttcaccgacgaggatttcaagaagccgcaggtggggatcgcctcgacctggagtcgcgtcacgccgtgcaacagccacatcaacgtgttggccgatgccgccagtgacggcgccgacgccgccggtggcaagggcgtggtcttcaataccatcaccatcagcgacggcatcgccaacggcaccgaaggcatgaagtattcgatggcctcgcgcgagatcatcgccgattccatcgaggcggtctccggctgcgaggggttcgacggggtggtggccatcggtggctgcgacaagaacatgcccggctgcatgatcggcctggcacgtctcaaccggcccagcatcttcgtctacggcggtaccatccagcccggtgccgggcacaccgacctggtctcggtattcgaggcgatgggcgcctactcccagggcaacaagtcgctgatcgaggtcaagcagatcgaggaagtcgcgattcccgggccgggctcctgtggcggcatgtacaccgccaacaccatggcctcggcgatcgaggccatgggcatgagcctgcccaattcgtcggctcaggacgcggtatcccagagcaagaaggacgatagtcgcgccgccggcgaggccgtgctcaagctgctcgaactggacatcaagccctcggacatcatgacccgcaaggcgttcgagaacgccatcaccgtggtcatcgccctcggcggttccaccaatgccgtgctgcacctgattgccatggccaacaccatcggggtcgagctctcgctcgacgactttaccgagatcggcaagcgcgtcccggtgctcgccgacctgcgccccagcggtcattatctgatgagcgagctggtggcgatcggcggcattcagccgatgatgaagattctgctcgatgcggggctgctccacggcgattgcctgaccgtgaccggcaagacgctggccgagaacctggccgacgtgacgccttatccgacggggcaggaaatcatcaagccgctggaggcaccgatcaaatcgagcagccacctgcgcattctctacggcaacctggcgccagagggagcggtggccaagatcaccggcaaggaaggtacccgcttcaccgggcgtgctcgcgtgttcaactccgaggaggaggcccaggcgcgcatcaacgacctgaccgtggccgccggtgacgtcgtcgtgattcgctacgaggggccgaagggcggtcccggcatgcgcgaaatgctgacgccgacctcggcgatcatgggccgtggcctgggcgacaaggtggccttgatcaccgatggacgcttctccggcggcagccatggcttcgtggtcggtcacatcacgccggaagccttcgtcggcggccccatcggcctggtcgaggacggtgacgagatcaccatcgacgccgagaacgacatcatgacgctgcatatcgacgacgccgagatggcgcgccgccgtgcggcctggaagcgcccggcaccgcgttatacgcgcggcacgctggccaagtacgccaagacggtcagctcggcatcgaaaggggcggtcaccgatctgcccgaagcgctggacgattga

SEQ ID NO: 188 - protein, 570 aa, Chromohalobacter salexigens
MSQQDSPANADHRRRHSSIVVDGPGKAASRAMLRAVGFTDEDFKKPQVGIASTWSRVTPCNSHINVLADAASDGADAAGGKGVVFNTITISDGIANGTEGMKYSMASREIIADSIEAVSGCEGFDGVVAIGGCDKNMPGCMIGLARLNRPSIFVYGGTIQPGAGHTDLVSVFEAMGAYSQGNKSLIEVKQIEEVAIPGPGSCGGMYTANTMASAIEAMGMSLPNSSAQDAVSQSKKDDSRAAGEAVLKLLELDIKPSDIMTRKAFENAITVVIALGGSTNAVLHLIAMANTIGVELSLDDFTEIGKRVPVLADLRPSGHYLMSELVAIGGIQPMMKILLDAGLLHGDCLTVTGKTLAENLADVTPYPTGQEIIKPLEAPIKSSSHLRILYGNLAPEGAVAKITGKEGTRFTGRARVFNSEEEAQARINDLTVAAGDVVVIRYEGPKGGPGMREMLTPTSAIMGRGLGDKVALITDGRFSGGSHGFVVGHITPEAFVGGPIGLVEDGDEITIDAENDIMTLHIDDAEMARRRAAWKRPAPRYTRGTLAKYAKTVSSASKGAVTDLPEALDD

SEQ ID NO: 189 - DNA, 1677 bp, Marinobacter algicola
atgacagaagacaaacgccgccgttattccgcgcccgtggtcgatggcctgggcaagtcggcaagccgcgccatgttgcgggccgtggggtttaccgatgaagatttccgcaaaccccagatcggtattgcctcgacctggagcaacctgacgccctgcaatatgcacatcaaccaactggcggaggaatcggccgcgggtgccgacgaggccgggggcaagagcctgacgttcaataccatcaccgtttccgacggcatcgccaacggcacggagggtatgaagtactccctggtgtcgcgggaagtcattgccgactccattgaaaccgtggctggttgtgaaggttttgatggcctggttgccattggcggctgcgacaagaacatgcccggctgcatgatgggcctggcgcgcctgaaccggccgtcggtatttgtctatggcggcaccatcatgcccggcgagaatcacaccgacatcatctcagtatttgaggcggtgggtgcccatgcccggggtgacctggacctgattgaggtcaaacagatcgaggaaaccgcgattccggggccaggctcctgcggcggcatgtacaccgccaacactatggcctcggcgattgaagccatgggcatgagcctgccgggcagttccgcccagaacgctgtttccgagaccaaggcggccgactgcagggcggcgggcgcggccgtcctcaacctgctggagaaagatctcaagccatcggacatcatgacccgggaggcgttcgagaatgctatcaccgtggtaattgccctgggtggctccaccaacgcggtgctgcacctgattgccatggccagcaccgttggcgttgacttgacgctggacgacttcgtggaaatcggcaaacgggttcccgtattggcagatctgcgccccagcggtcactacatgatgtcggaactggtggcgatcggcggcattcagccgttgatgaagatgctgctcgaccgtggcatgctccatggcaactgcatgaccgtcaccgggcagacactggcggacaacctgaaagacgtggctccgtacccggcaagccaggacatcattcatgcctttgatgaccccatcaaggcggatagccatctgcgtatcctttacggcaacctggcgcctactggtgcggtggccaagatcactggtaaggagggtacccatttcaccggccgtgcacgggtgttccagtccgaggaagaggcccaggagcggatcatggacggcaccgttgtggccggagacgtgttggtgatccggtttgaaggccccaaaggtgggccgggcatgcgggagatgctaacgccgacttctgccatcatgggtaaagggctgggcagcgatgtggcgctgattaccgacgggcgtttttccggtggcagccacggtttcgtggttggtcatattacgccggaggccgcagaaggtgggccgattgcgctggtggaaactggcgacaccatcaccattgatgcagtggccaatcgcattgagctggatgtttcggagcaggaaatggagcgccgccgacaggcatggaccgcaccggctccccgatttacccgcggggtgctggccaaatacgcgcgcaccgtgagttccgcttcggaaggcgcagtgacagacaagccgtga

SEQ ID NO: 190 - protein, 558 aa, Marinobacter algicola
MTEDKRRRYSAPVVDGLGKSASRAMLRAVGFTDEDFRKPQIGIASTWSNLTPCNMHINQLAEESAAGADEAGGKSLTFNTITVSDGIANGTEGMKYSLVSREVIADSIETVAGCEGFDGLVAIGGCDKNMPGCMMGLARLNRPSVFVYGGTIMPGENHTDIISVFEAVGAHARGDLDLIEVKQIEETAIPGPGSCGGMYTANTMASAIEAMGMSLPGSSAQNAVSETKAADCRAAGAAVLNLLEKDLKPSDIMTREAFENAITVVIALGGSTNAVLHLIAMASTVGVDLTLDDFVEIGKRVPVLADLRPSGHYMMSELVAIGGIQPLMKMLLDRGMLHGNCMTVTGQTLADNLKDVAPYPASQDIIHAFDDPIKADSHLRILYGNLAPTGAVAKITGKEGTHFTGRARVFQSEEEAQERIMDGTVVAGDVLVIRFEGPKGGPGMREMLTPTSAIMGKGLGSDVALITDGRFSGGSHGFVVGHITPEAAEGGPIALVETGDTITIDAVANRIELDVSEQEMERRRQAWTAPAPRFTRGVLAKYARTVSSASEGAVTDKP

SEQ ID NO: 191 - DNA, 1677 bp, Marinobacter aquaeolei
atgacaaccgataaacgacgccgacactcggcaccggtggtagacggtatcaataaatccgccagccgggccatgctccgggcggtaggttttaccgacgaggatttccgcaaaccccagattggcattgcctccacctggagcaaccttacgccctgcaacatgcacattgacggcctggcccgggaggccgccaagggtgccgacggagccgggggcaagagcctgatcttcaacaccatcactatctctgatggcatcgccaacggcaccgagggcatgaaatattccctggtgtcgcgcgaggtgattgccgattccattgagaccgtggccggttgtgagggcttcgacggactggtcgccatcggtggctgcgacaagaacatgcccggctgcatgatgggcctggcccggctgaaccggccctcggtcttcgtttacggcggcaccatcatgcccggcgagaaccataccgacatcatctccgtgtttgaggcggtgggcgcccatgcccgcggtaacatggagctgatcgaagtcaaacagatcgaggaaaccgcgattcccgggccaggctcctgtggcggcatgtacaccgccaacaccatggcctccgccattgaggccatgggtatgagcctgccaggcagctcggcccagaacgccatctccgacagcaaactggcggattgcgaagccgcaggcgccgcggtgctgaaactgctcgaagccgatatcaagccctccgacatcatgacccgggaagcgttcgagaacgccatcaccgtggtggtcgcgctgggcggttccaccaacgccgtgctgcaccttctgggtatggccagtaccgtgggagtggagctgtcactggacgatttcgtacgcatcggcaaacaggtaccagtcctggcggaccttcgcccctccggccactacatgatgtccgagctggtggccattggtggcattcaaccgctaatgaagatgctgctcgaccgggggctgctgcatggagactgcctcacggtaaccggcaaaaccctggcagagaatctcgagaccgtggtgccctaccccgaagaccagcagatcatccacgccttcgacaacccgatcaaagccgacagtcatctgcgtattctctatggcaacctggctccggaaggctcggtggcgaaaatcaccggtaaggaaggcacgcatttttccggtcgagcccgagtgtttcactctgaagaggaagcccaggagcgaatcctggatggcaccgtggtcgctggcgacgtgctggtgatccgatacgaaggcccgaagggcgggcctggcatgcgggaaatgctcagccccacctcggcgattatgggcaaaggtcttggcagtgatgtggctctgattacagacggccgcttctccggtggcagtcatggttttgtggttggccatatcacaccagaggccgccgtgggcgggccgattgcgctggtagaagacggcgacaccattaccattgatgccgtgagcaactcgattgtgctggaaatctctgacgaggaaatggaaaaacggcgcaaagcctggacgccgccggaacccagatttacccggggcgtgctggccaaatatgcccgtgtggtgagctctgcatctacgggggccgttaccgacctgccctag

SEQ ID NO: 192 - protein, 558 aa, Marinobacter aquaeolei
MTTDKRRRHSAPVVDGINKSASRAMLRAVGFTDEDFRKPQIGIASTWSNLTPCNMHIDGLAREAAKGADGAGGKSLIFNTITISDGIANGTEGMKYSLVSREVIADSIETVAGCEGFDGLVAIGGCDKNMPGCMMGLARLNRPSVFVYGGTIMPGENHTDIISVFEAVGAHARGNMELIEVKQIEETAIPGPGSCGGMYTANTMASAIEAMGMSLPGSSAQNAISDSKLADCEAAGAAVLKLLEADIKPSDIMTREAFENAITVVVALGGSTNAVLHLLGMASTVGVELSLDDFVRIGKQVPVLADLRPSGHYMMSELVAIGGIQPLMKMLLDRGLLHGDCLTVTGKTLAENLETVVPYPEDQQIIHAFDNPIKADSHLRILYGNLAPEGSVAKITGKEGTHFSGRARVFHSEEEAQERILDGTVVAGDVLVIRYEGPKGGPGMREMLSPTSAIMGKGLGSDVALITDGRFSGGSHGFVVGHITPEAAVGGPIALVEDGDTITIDAVSNSIVLEISDEEMEKRRKAWTPPEPRFTRGVLAKYARVVSSASTGAVTDLP

SEQ ID NO: 193 - DNA, 1692 bp, Marinobacter sp.
atgagtgataccccccaagaccctcgccgccgttattccgctccggttgtggacggtgtggctaaatccgccagtcgttccatgctgagggccgtcggttttaacgacgaagatttcagcaaaccgcagatcggcattgcttccacctggagtatggttaccccctgtaatagccacattaacgagctggccgacattgcttgtaagggtgcggaccaggccggtggtaaaggcgttatttttaacaccattacgatttctgacggcattgccaacggcaccgaaggaatgaagtattccctggtgtcgcgggaagtcatcgcagattccattgaaaccgtggccggttgcgagggttttgacggcctggttgccattggcggctgtgacaaaaacatgcccggctgcatcatgggcctggcgcggcttaaccggcccagcgtgtttgtttatggcggtactattttgcctggtgaaggtcacaccgacattatttcagtgtttgaagcggtgggcgcccatgccaaaggcgaactgtcgttgattgaagtgaagcatattgaagaaaccgccattcccggccccggttcctgtggcggcatgtacaccgccaataccatggcctcggccatagaagcactgggtatgagcctgcccggcagctcggcgcagaatgcggtgtcgaatgacaaaaaagccgattgcgaagccgccggtgccgcggtcatgaatctgttggatcgagatatcaaaccttccgacattatgactcagcacgcctttgagaacgccatcactgtgatcatcaccttgggtggttccaccaacgccgtactgcacctgattggtatggccaacacggcgggtgtagagctaaccctggatgacttcactcgcattggtaaaaaggttccattgttggcggatctgcgccctagcggccattacatgatgagcgaattggtggccattggcggcatccagccactcatgaaaatgctgctagacgccggcatgctccacggcgattgcctgacagtaaccggcaaaactctggccgaaaacctggccacggtagaaccttatgccgatggccagaaaatcattatgcctctggaccagcccattaaagcggaaagccacctgcgcattctgtttggtaatctggcgccggaaggctccgtggcaaaaattaccggtaaggaaggcacccactttaaaggtcgggcgcgggtgtttggttcggaagaagaagcccaagcacgaattctggacggcactgtggtggctggcgatgtgctggttatccgctatgaaggcccacgcggcggccccggcatgcgcgaaatgctgtcacccacctcggcgattatgggccgtgggctgggcagcgatgtggctttgataactgacggtcgtttctccggtggtagccacggcttcgtcgtaggccacattacgccggaagcgtttgatggcggccctattgccttggtgcaagacggcgacgaaatcgtgattgatgccgtggccgacactattgagctaaatgtcagtgacgacgaactgcagagccgtcgcgacgcctggcagcaaccgcaaccgcgttacacccgcggtgtgttagccaagtatgcgcgcaccgtgagttcggcgtcgaccggtgcagtgaccgacctgcccgagccttga

SEQ ID NO: 194 - protein, 563 aa, Marinobacter sp.
MSDTPQDPRRRYSAPVVDGVAKSASRSMLRAVGFNDEDFSKPQIGIASTWSMVTPCNSHINELADIACKGADQAGGKGVIFNTITISDGIANGTEGMKYSLVSREVIADSIETVAGCEGFDGLVAIGGCDKNMPGCIMGLARLNRPSVFVYGGTILPGEGHTDIISVFEAVGAHAKGELSLIEVKHIEETAIPGPGSCGGMYTANTMASAIEALGMSLPGSSAQNAVSNDKKADCEAAGAAVMNLLDRDIKPSDIMTQHAFENAITVIITLGGSTNAVLHLIGMANTAGVELTLDDFTRIGKKVPLLADLRPSGHYMMSELVAIGGIQPLMKMLLDAGMLHGDCLTVTGKTLAENLATVEPYADGQKIIMPLDQPIKAESHLRILFGNLAPEGSVAKITGKEGTHFKGRARVFGSEEEAQARILDGTVVAGDVLVIRYEGPRGGPGMREMLSPTSAIMGRGLGSDVALITDGRFSGGSHGFVVGHITPEAFDGGPIALVQDGDEIVIDAVADTIELNVSDDELQSRRDAWQQPQPRYTRGVLAKYARTVSSASTGAVTDLPEP

SEQ ID NO: 195 - DNA, 1680 bp, Pseudoalteromonas haloplanktis
atgacttctgaaaaaccacgtaaatattcacaaaaaattgtagatggtagcgctcaggctcctagtcgttctatgttacgagcggtaggttttaatgatgacgattttaaaaagtctcaagttggtattgcctctacatggtctatggtaacgccgtgcaatatgcacattaatacacttgccgaagaagtaggtaaaggcgtagatagcgccggtgcgaaaagcgttatatataataccattaccgtatccgatggtatttctatgggcaccgaagggatgaaatattctttagtatcacgcgaagtaatttgcgactcaatagaagcggtatcggcgggtatgggccacgacggtattattgctattggcggttgtgataaaaatatgccgggttgtttaatgggtttagcacgtttaaaccgcccctctatatttgtgtacggcggtacaattttacccggtgaaaatcataccgatatagtctcggtatttgaagcggtgggcagctacgcggcaggcgatattccaattacgcaattagaacatattgaaaaaacagccataccaggggctggttcgtgtggtggtatgtacacggcaaatacgttagcctcagcaattgaagctttaggcatgagtatgccaaatagttctgcgcaaaatgctatttcacaaaacaaaaaacaagactgtattgatgcgggtaaagcgattgtttatttgctagagcatgacattaaaccttccgatattatgaccaaaaaagcgtttgaaaatgcaattacgctgatcattaccttaggcggctcaaccaatgcggtgctgcatttaatcgctatggctgatgcggtaggcgttgaagtaacattggatgactttgtgcgtattggcgataaaacaccagtaattgccgacttgcgtcccagcggtcaatatttaatgtcggagttgattgaaattggtggcattcaaccactgatgaagcgtttattagatgccggtatgctgcacggtgactgtatgacagtgacaggcaaaaccatggccgaaaatttagccgatgtagcagattacccagcagggcaaaatattattttaccttttgataagccgattaaaaaagacagccatttagttatattagctggtaatttagcgccagaaggggcagtgtcaaaaattacgggtaaagagggtttacgctttaccggcaacgcaaaagtatatgactcagaagagcaaggttttgccgctattatagatgggcaagtagtagccggagacgttgtagtaattcgctatgaaggccctaaaggtggcccaggtatgcgtgaaatgctaagccccacttcagctattatgggtaaaggtttaggtaacgatgtggcgcttattaccgatggtcgtttttcaggtggtagtaggggttttgttgtggggcacgttacaccagaagcttacgaaggcggcgccattgcactagtagaaaatggtgacagcattactattgacgcgcaaagccgtgaaatgactcttaatattactgatgaagaaatggccagtaggaaacaacgttggcaacaacctgcgccaaaatacacccgcggattactagcaaaatatgccagaacagtaagttcagcttctaccggagccgtgaccgataagccaagttaa

SEQ ID NO: 196 - protein, 559 aa, Pseudoalteromonas haloplanktis
MTSEKPRKYSQKIVDGSAQAPSRSMLRAVGFNDDDFKKSQVGIASTWSMVTPCNMHINTLAEEVGKGVDSAGAKSVIYNTITVSDGISMGTEGMKYSLVSREVICDSIEAVSAGMGHDGIIAIGGCDKNMPGCLMGLARLNRPSIFVYGGTILPGENHTDIVSVFEAVGSYAAGDIPITQLEHIEKTAIPGAGSCGGMYTANTLASAIEALGMSMPNSSAQNAISQNKKQDCIDAGKAIVYLLEHDIKPSDIMTKKAFENAITLIITLGGSTNAVLHLIAMADAVGVEVTLDDFVRIGDKTPVIADLRPSGQYLMSELIEIGGIQPLMKRLLDAGMLHGDCMTVTGKTMAENLADVADYPAGQNIILPFDKPIKKDSHLVILAGNLAPEGAVSKITGKEGLRFTGNAKVYDSEEQGFAAIIDGQVVAGDVVVIRYEGPKGGPGMREMLSPTSAIMGKGLGNDVALITDGRFSGGSRGFVVGHVTPEAYEGGAIALVENGDSITIDAQSREMTLNITDEEMASRKQRWQQPAPKYTRGLLAKYARTVSSASTGAVTDKPS

SEQ ID NO: 197 - DNA, 1686 bp, Acinetobacter sp.
atgagtaaagacaatatacgccagtattcggcaccagtttatgacggtattgaaaatgcccctgcacgttcgatgatgcgtgctgtgggctttcaagataaagattttaatcgtccatttattggcattgcttcaacatgggccaatgtcacgccgtgcaacatgcacattgatggactggcacgagaagctgaacatggggtgaatcaggccagcggtaagggaattatttttaacactattaccatttctgacggtatttcaaacggtaccgaaggcatgaagtattctttggtttctcgtgaaattattgcagactctattgaggcggtcattggttgtcagggttacgatggtgtaattgccattggtggctgcgacaaaaacatgcctggctgtattatggggctggcacgtttgaaccgtccaggcttgtttatttatggcggcaccattcaaccaggtgaaggacataccgacatgatttcggtgtttgaagcggtgggacagtacgccaaaggagaaatcaatgccattcaggtcaagcagattgaagaagtcgctttaccaggaccaggttcttgcgggggaatgtataccgccaataccatggcttctgctattgaagcactgggaatgagtttaccaggttcttctgcacaggatgccatttctgaagaaaagcgtcaggactgtcatcgtgcgggcgaggcggtgatgaacctgcttcggctggatattcgtccacgcgatattatgaccaaagcggcatttgagaatgccattaaggtcgtcattgctttgggcggttcaaccaatgccgtattgcatttgattgcaatggcacatacggctgaggtaaagcttgatctggatgattttgtacgaattggtcaggaaacacctgtggtggcagatttacgaccatcgggtaagtatctcatgtccgaactgatcaagattggtgggattcagccgttgatgaagcgaatgctggaacgcggcatgctggatggtagttgtctgactgtaactggtaagacccttgcagagaatttggccgaggttgaggattatcctgccgatcaacaaattatcttgccatttgagcaacctgttaagaaagactcccatctagtgattcttaagggtaatttgtccccgacaggtgccgttgccaaaattacgggcaaagaaggtttatattttgaagggccagcccgcgtttttgaaggcgaagaaggcgccatgcgtggcattctagacggagaagtacaagagggcgaagttgtcgtcattcgtggtgaaggacccaaaggtggaccaggcatgcgcgaaatgctgaaaccaacgtctgcaattattggtaaaggactgggacaatcggtggcgctgattaccgatgggcggttttcgggcggcagtcatggctttgtcattggccatgtgaccccagaagcttacgaaggtgggcctattggtttggttgaaaatggtgataaaatttcaatcaatgctgaaacgcgtgaaatcaccttacatatttctaacgaagaaatgagcttacgtcgtgcaaaatggcagaaaccagaaccaaaatataaatctggtgctttggcaaaatttgcaaaacttgcagcaggtgcggacaaaggcgcagttactgatttaaatcttgatgtgtaa

SEQ ID NO: 198 - protein, 561 aa, Acinetobacter sp.
MSKDNIRQYSAPVYDGIENAPARSMMRAVGFQDKDFNRPFIGIASTWANVTPCNMHIDGLAREAEHGVNQASGKGIIFNTITISDGISNGTEGMKYSLVSREIIADSIEAVIGCQGYDGVIAIGGCDKNMPGCIMGLARLNRPGLFIYGGTIQPGEGHTDMISVFEAVGQYAKGEINAIQVKQIEEVALPGPGSCGGMYTANTMASAIEALGMSLPGSSAQDAISEEKRQDCHRAGEAVMNLLRLDIRPRDIMTKAAFENAIKVVIALGGSTNAVLHLIAMAHTAEVKLDLDDFVRIGQETPVVADLRPSGKYLMSELIKIGGIQPLMKRMLERGMLDGSCLTVTGKTLAENLAEVEDYPADQQIILPFEQPVKKDSHLVILKGNLSPTGAVAKITGKEGLYFEGPARVFEGEEGAMRGILDGEVQEGEVVVIRGEGPKGGPGMREMLKPTSAIIGKGLGQSVALITDGRFSGGSHGFVIGHVTPEAYEGGPIGLVENGDKISINAETREITLHISNEEMSLRRAKWQKPEPKYKSGALAKFAKLAAGADKGAVTDLNLDV

SEQ ID NO: 199 - DNA, 1737 bp, Opitutaceae bacterium
atgaagccgacgaccgccaagaccaagcctgccacagccgccaagaccgccaacgccacgcgccagttctcctccatcgtgcacgacggagccgaccgcgcccccaatcgctccatgctccgcgccgtcggattcggcgatgcggatttcaagaaaaccgtcgtcggcgtcgcctccacctggtcgatgctcaccccgtgcaacatgcacatcaacaagctcgccgaatacgccgagcagggcgccaacgaagccggcggcaagggcatcatcttcggcaccatcaccatcgccgacggcatcagcatgggaacgcccggcatgcgctactcgctcgtgtcccgcgaagtcattgccgactccatcgaaaccgtggttggcggcgaaggttttgacggccttgtcgccatcggcggctgcgacaaaaacatgcccggctgcgttatggccatggcccgtctcaaccgccccagcgttttcgtttacggcggcaccattcttcccggcatccacccggaaaccaaaaaggacctcgacatcgtttccgtcttcgaagccgtcggccagcacgccgcgggcaagatcaacgacgctgcgctcaaggttgttgaggaatgctccatccccggtcccggttcctgcggcggtatgtataccgccaatacaatggccaacgccatcgaagccctcggcctctcgctgcccaattcctccgcgcaaatcgccatctccaaggaaaaacaagaagactgtcgccgcgccggagccgctgtcgttgaactcgcaaaaaaggggattcgtccgcgtgacattttaaccaaaaaagcctttgaaaacgccatcactgtagtgatcgccctcggtggctcaaccaatgccgtcctgcacctcctcgccatcgcgcacactgccggcgtgaagctcaccatcgacgacttcacccgcatcggcaaacgcgtgcccgtgctcgccgatctcaaaccttcgggcaaatacggcatggtgcatctctctcgcatcggcggcgtgcctccgctcatgaagaccttgctcgaccgcggtctcatccacggcgactgcctcaccgtcaccggcaagaccgtggcggaaaacctcaaggacgtgcagccgtatccagaaaatcaggacgtgatccgtccctttgaccaaccgatcaagcccgacagccacctgcgcattctctacggcaacctcgccgccgagggttccgtggccaagatctccggcaaggaaggcttaaagttttccggcaaagccatcgtgttcgagggagaggaggccgcgttgtctgccatcctcgacggacgcgtgaagtccggccacgtcgtcgtgatccgcaatgagggtcccgtgggcggccccggcatgagggagatgctcgcccccaccagcgccatcatgggcaagggactcggcaaggaagtcgcgctcatcaccgacggacgtttttcgggcggttcgcacggatttgtggtcggccacatcacacccgaggcggcgattggcggcaccatcggcgtcgtgaaaaacggcgacccgatcaccatcgacgccgtaaaaaaccagatcacgctcgacattcccgcgaaggaaatcgccgcgcgcaaaaagacctggaagccacgcaagccctacaccaatcgcggtgtgttggcgaagtatgccaaactcgtcagcaccgccagcgaaggcgcggtgacggacaagtatttgtaa

SEQ ID NO: 200 - protein, 578 aa, Opitutaceae bacterium
MKPTTAKTKPATAAKTANATRQFSSIVHDGADRAPNRSMLRAVGFGDADFKKTVVGVASTWSMLTPCNMHINKLAEYAEQGANEAGGKGIIFGTITIADGISMGTPGMRYSLVSREVIADSIETVVGGEGFDGLVAIGGCDKNMPGCVMAMARLNRPSVFVYGGTILPGIHPETKKDLDIVSVFEAVGQHAAGKINDAALKVVEECSIPGPGSCGGMYTANTMANAIEALGLSLPNSSAQIAISKEKQEDCRRAGAAVVELAKKGIRPRDILTKKAFENAITVVIALGGSTNAVLHLLAIAHTAGVKLTIDDFTRIGKRVPVLADLKPSGKYGMVHLSRIGGVPPLMKTLLDRGLIHGDCLTVTGKTVAENLKDVQPYPENQDVIRPFDQPIKPDSHLRILYGNLAAEGSVAKISGKEGLKFSGKAIVFEGEEAALSAILDGRVKSGHVVVIRNEGPVGGPGMREMLAPTSAIMGKGLGKEVALITDGRFSGGSHGFVVGHITPEAAIGGTIGVVKNGDPITIDAVKNQITLDIPAKEIAARKKTWKPRKPYTNRGVLAKYAKLVSTASEGAVTDKYL

SEQ ID NO: 201 - DNA, 1683 bp, Flavobacterium sp.
atggaattaaataaatacagtaaaactgtaactcaagacccaacattgcctgcggctcaagcaatgctgcacgcaataggtttaaccgatgaagatctcaagaaaccattaattggtatcgcaagtactggttatgaggggaatccttgtaatatgcaccttaatgatttggcaacctacgtcaagaaaggtgcgtctaatgcagatttagtcggacttattttcaatacgatcggtgtaagtgatggtatttctaacggaactccgggaatgcgtttctcgctgccgtcacgtgatatcatcgctgattctatggaaaccgtggttcaagcaatgagttatgacggtctggttacagttgtgggctgtgataaaaatatgccgggggcattaattgcgcaattgcgattaaatcgcccgtcaattttagtttatggaggaacgatcgcttccggatgccataacggaaaaaaactagatatcatttctgcttttgaggcttatggtcaaaaagttgcaggaactattgatgataatgagtttaaagaagtagtacacaaagcgtgtccgggtgccggtgcttgtggtggtatgtatactgcaaatactatggcttctgctattgaagctttaggaatgtcattgccttttaactcatcgaaccctgcagttactgatgctaatattaaagagcaggaatgtattaaagcaggtgaggctttaaaatatttattagagcaggatattaaaccttcagatattgtaacaaaagagtcgctcgagaatgcgattcgcttggtgactgttttgggaggttctaccaacgcagtattgcactttttagcaatagctaaagcagctcaggtagattttacgctagaagattttcagcgcctgagtgataatacaccgttgttagcagatcttaaaccttcaggtaaatattctatggaagatttacacggtgttggcggaattccgggagtattaaaatatatgcttgataacggtatgcttcacggggattgtttaaccgttaccggaaaaactttagctgaaaacctaaaagatgttcccaatcttatagatggtcaggatattattagaccgttgaataagccaattaaagatagtggccatatccgtatactattcgggaacttggctactgaaggagctgtagcaaagattaccggtaaggaagggctttcgtttacaggaactgccaatgtattcaacagcgaattagaggtaaacgaaggaattaaatcaggaaaagttaaaaaaggtgacgtagtgatcattcgctatgaaggacctaaaggtggtcccggaatgccagaaatgcttaagcctacctcttcaattatgggagccggtttaggtaaagacgttgctttgattactgacggaagattctctggtggatcgcacggatttgtggtggggcacgtttctcccgaagcacaagtgggtggaaatatcgcacttgtagaaaatggagatgtcatttctattgatgccgtaaagaataccatcaacatcgatattaccgatgaagaattggcaaaacgaagagaaaaatggacagctccggaacttagattccaacgcggagcgttatataaatatgcgaaaacagtctcgtcagcttctaaaggttgtgtgacagacgaaatgtag

SEQ ID NO: 202 - protein, 560 aa, Flavobacterium sp.
MELNKYSKTVTQDPTLPAAQAMLHAIGLTDEDLKKPLIGIASTGYEGNPCNMHLNDLATYVKKGASNADLVGLIFNTIGVSDGISNGTPGMRFSLPSRDIIADSMETVVQAMSYDGLVTVVGCDKNMPGALIAQLRLNRPSILVYGGTIASGCHNGKKLDIISAFEAYGQKVAGTIDDNEFKEVVHKACPGAGACGGMYTANTMASAIEALGMSLPFNSSNPAVTDANIKEQECIKAGEALKYLLEQDIKPSDIVTKESLENAIRLVTVLGGSTNAVLHFLAIAKAAQVDFTLEDFQRLSDNTPLLADLKPSGKYSMEDLHGVGGIPGVLKYMLDNGMLHGDCLTVTGKTLAENLKDVPNLIDGQDIIRPLNKPIKDSGHIRILFGNLATEGAVAKITGKEGLSFTGTANVFNSELEVNEGIKSGKVKKGDVVIIRYEGPKGGPGMPEMLKPTSSIMGAGLGKDVALITDGRFSGGSHGFVVGHVSPEAQVGGNIALVENGDVISIDAVKNTINIDITDEELAKRREKWTAPELRFQRGALYKYAKTVSSASKGCVTDEM

SEQ ID NO: 203 - DNA, 1680 bp, Cellulophaga sp.
ttgaaagaacttaataaatatagtaaagcggtaactcaagatcctacgcagccagctgctcaggcaatgttgcacgctataggacttacagatgaagattttaaaaagccacttgtaggtattgcaagtacaggttatgagggtaatccttgtaatatgcacttaaataaccttgcactagatattaaaaaaggagtacaaacttctgatctggtaggtcttatttataataccataggtgtaagtgacggtatctcaatgggtactcctggtatgcggtactcactacctagtagagatattattgcagactcaatggagactgtagtacaagctatgtcttatgatgcactggttacagtggtaggttgtgataaaaatatgccgggtgctcttatggcacagcttaggctagatagaccatctatactcgtctatgggggaactatagcaccaggatttcacgaagataaaaagctagatgtagtgtctgcttttgaagcttggggagaaaaagtagctggtagtattacagagcaagagtttaaaacggtggtaaaaaaagcctgtccaggtgctggtgcgtgtggtggtatgtatactgcaaacacgatggcaagcgcgattgaggcactagggatgagcttaccctatacaagttctaaccctgcagtgtcacctaataaaactgcggagtgtgctagagtaggagctgctttaagaaacctaatagaaaaagacataaaaccctcagacattgttactcgcaagtcactagagaatgcggtgagacttgtaaccgtacttggaggatctactaatgctgtgctgcactttctcgctatagcaaaggctgcacaagtatcatttacactagaagattttcaaaaaataagcgacaccacaccttttctagcagatcttaaaccatcaggaaaataccttatggaagatttacataatgtaggaggagtgccgggcgtattaaagtatatgctagagcaaggtatgttgcacggtgactgtatgaccgtaactggtaaaactattgcagagaatctagcagttgtagaccatcttcaggcacatcaagatgttattcattcggttgagaatcctattaaagagacgggacacattcgtattctttatggaaatattgcaagtgaaggatctgtggcaaaaattacaggtaaagagggattacattttcgcggaagcgcaagagtttacaacggtgagtatgctgcaaacgcgggtataggtgcaggagaggtgaaaaagggtgatgtagtagttatacgctacgaagggccacaaggaggaccgggtatgccagaaatgctcaaacctacagcggctattatgggtgctggcttaggtaaggatgtggcacttattacagatggacgtttttctggaggtacacacggctttgttgtggggcacattactccagaggctcaagtaggtggtgggattgcgcttatagaaaatggagataccattgtgattaacgctgagactaacacaattaatgttgagataagtgagagcgaactagaagcacgtaaaaagaactgggtagctccagagcttaaagtaaaacgtggctcactttataaatatgctcgtatggtctcatctgcgagtgagggatgcgtgacagacgagttctag

SEQ ID NO: 204 - protein, 559 aa, Cellulophaga sp.
MKELNKYSKAVTQDPTQPAAQAMLHAIGLTDEDFKKPLVGIASTGYEGNPCNMHLNNLALDIKKGVQTSDLVGLIYNTIGVSDGISMGTPGMRYSLPSRDIIADSMETVVQAMSYDALVTVVGCDKNMPGALMAQLRLDRPSILVYGGTIAPGFHEDKKLDVVSAFEAWGEKVAGSITEQEFKTVVKKACPGAGACGGMYTANTMASAIEALGMSLPYTSSNPAVSPNKTAECARVGAALRNLIEKDIKPSDIVTRKSLENAVRLVTVLGGSTNAVLHFLAIAKAAQVSFTLEDFQKISDTTPFLADLKPSGKYLMEDLHNVGGVPGVLKYMLEQGMLHGDCMTVTGKTIAENLAVVDHLQAHQDVIHSVENPIKETGHIRILYGNIASEGSVAKITGKEGLHFRGSARVYNGEYAANAGIGAGEVKKGDVVVIRYEGPQGGPGMPEMLKPTAAIMGAGLGKDVALITDGRFSGGTHGFVVGHITPEAQVGGGIALIENGDTIVINAETNTINVEISESELEARKKNWVAPELKVKRGSLYKYARMVSSASEGCVTDEF

SEQ ID NO: 205 - DNA, 1680 bp, Kordia algicida
atgaacaatctcaataaatacagcaaaacagtcacacaagatcctacgcaacctgcggcacaagccatgttgcatgccattggattaacgaaagaagactttttcaaacccatcatcggaattgcaagtacaggttacgaaggaaatccgtgcaacatgcacctaaacgatctggcaaaactggcaaaacaaggaacaaaaaatgaggaggttgtcggacttattttcaatacaattggcgtaagtgatggaatctccatgggaacaccaggaatgcgttattcattgccttcacgcgatatcattgccgattctatggaaacggtagtgcaagcaatgagttatgacggattaatcacggttgttggttgtgacaaaaacatgccaggcgcactaatggcaatgattcgcctaaatcgcccaagtatcttagtctatggcggaaccattgattctggttgtcacaacggaaaaaaactcgatgttgtttctgcttttgaagcttggggaagcaaagttgcaggaactatggacgaaacagaataccaaaacattgttgaaaaagcgtgtccaggtgctggtgcttgtggcggaatgtacaccgcaaacaccatggcttctgctatagaagcattgggaatgacattaccattcaattcatcaaatcctgcgttgagcgatgctaaaaaacaagaatcggttgcggcgggcgaagcaatgcgtgttttgttagaaaaagatatcaaaccatcagacattattactcgaaaatctttggaaaatgcagttcgtttagtaacaattttgggcggatcaaccaatgcagtattacacttcttagcaattgccagagctgcacaaattgatttcacactcaaagactttcaagaaataagcgatgaaacgccgtttttggcagacttaaaacctagtggaaaatacttaatggaagacgtacacgctgtcggcggaattcctgcggtattaaaatatttactcaaaaaaggattgcttcatggcgattgtttaacggttacgggaaaaacaatggcagaaaatttattagatgtcgatgacttaacagaaggtcaagatgtcatcaaacctgtggaaaatccaataaaaatatcaggacacttacgcatgctttatggaaacctagcaagtgaaggaagcgtggcaaaaatcacaggaaaagaaggtttaaaattctctggaaaagcaaaagtatttgaaggtgaatacgaagccaatgacggaattcgtgatggaaaagtgcaaaaaggagacgtcgtcgtcattcggtatgaaggaccaaaaggcggaccaggaatgccagaaatgctaaagccaacagcagcaatcatgggtgcaggtttaggaaaagatgttgcattaattactgatggacgcttttctggaggaacacacggttttgtcgtcggacacatcacgccagaagcacaagaaggcggaacacttgctttagtaaaagatggcgatatcattaccattgatgcagaaacgaatacgatacaattagaagtttcaaacgaagaacttcaagaacgtaaaaaacaatggaaagcacccgaactcaaatttgaacgcggtgtattatacaaatatgcaaaaacagtttcatctgcatccaaaggttgcgtaactgatgaattttag

SEQ ID NO: 206 - protein, 559 aa, Kordia algicida
MNNLNKYSKTVTQDPTQPAAQAMLHAIGLTKEDFFKPIIGIASTGYEGNPCNMHLNDLAKLAKQGTKNEEVVGLIFNTIGVSDGISMGTPGMRYSLPSRDIIADSMETVVQAMSYDGLITVVGCDKNMPGALMAMIRLNRPSILVYGGTIDSGCHNGKKLDVVSAFEAWGSKVAGTMDETEYQNIVEKACPGAGACGGMYTANTMASAIEALGMTLPFNSSNPALSDAKKQESVAAGEAMRVLLEKDIKPSDIITRKSLENAVRLVTILGGSTNAVLHFLAIARAAQIDFTLKDFQEISDETPFLADLKPSGKYLMEDVHAVGGIPAVLKYLLKKGLLHGDCLTVTGKTMAENLLDVDDLTEGQDVIKPVENPIKISGHLRMLYGNLASEGSVAKITGKEGLKFSGKAKVFEGEYEANDGIRDGKVQKGDVVVIRYEGPKGGPGMPEMLKPTAAIMGAGLGKDVALITDGRFSGGTHGFVVGHITPEAQEGGTLALVKDGDIITIDAETNTIQLEVSNEELQERKKQWKAPELKFERGVLYKYAKTVSSASKGCVTDEF

SEQ ID NO: 207 - DNA, 1680 bp, Flavobacteriales bacterium
atgagtcaattaaacaaatacagtaaaactgttacacaagatccaacgcagccagctgctcaagcaatgcttcatgctattggattaactaaagaagatttttataaacctattgtaggaattgcaagtacaggttacgaaggtaacccttgtaatatgcacctcaatgacctagcgaaattggtcaaagaaggcacaaagaatgaagatgtcgtcggcttaattttcaacacaattggtgtaagtgatggcatttctatgggaacaccaggaatgcgttactcattaccttcaagagatattattgcagattctatggaaactgtagtacaagccatgagttatgatggtttagtcactgtagttggttgcgacaagaatatgcctggagccttaatggctatgataagattaaatcgtccttcgattttagtttatggaggcacaattgattctggttgtcataatgggcaaaaattagatgttgtttctgcatttgaagcttggggaagcaaagttgcaggtactatgaccgaaaatgaataccaaaatatagttgaaaaagcatgtcctggagctggtgcttgtggaggtatgtacacagcaaacacaatggcttctgctattgaggctctaggtatgacattaccttttaactcttctaatccagccttaagtgatgcaaagaaagaagagtctgtaaaagctggagaagctttaagagttttactcgaaaaagatattaagccttcagatattataactagaaaatcacttgaaaatgcagtaagattagttaccatattaggtggctctacaaatgctgtattacactttttagccattgcaagagcagctcaaattgatttcacattaaaagattttcaagatataagtgataacactccattcttagcagatttaaaaccaagtggaaaatacttaatggaagatgtacatgctgtaggaggaattcctgcggtattaaaataccttcttaaaaaaggattaattcacggagattgtttaaccgttaccggaaagacaatagctgagaatttattagatgttgctgacttaaccgaaggtcaagacgtcatcaaacccatcgaagaaccaattaaaatttctggacacttaagaatgctctacggaaacctagccactgaaggtagtgttgcgaaaattactgggaaagagggcttaagttttaaagggaaagcaaaagtatttgaaagtgaatatgatgcaaacgatggcattagagatggaaaagtagaaaaaggtgatgtcgtagtcattcgatacgaaggtccaaaaggagggcctggaatgccagaaatgctaaagccaactgctgctattatgggagctggtttaggtaaagatgtagccttgattactgatggaagattctctggaggaactcacggttttgtcgttggacacatcacacctgaagcacaagaaggcggcactcttgcttttgttgaagatggagatattattacaattgatgccgaaaccaatacgatttcagtagaagtatctgaacaagaattacaaaaaagaagaaaaaattggaaagctccagatttaaaatttgaacgtggagtactttataaatatgcaaagacagtatcatcagcttcaaaaggctgtgttactgatgaattttaa

SEQ ID NO: 208 - protein, 559 aa, Flavobacteriales bacterium
MSQLNKYSKTVTQDPTQPAAQAMLHAIGLTKEDFYKPIVGIASTGYEGNPCNMHLNDLAKLVKEGTKNEDVVGLIFNTIGVSDGISMGTPGMRYSLPSRDIIADSMETVVQAMSYDGLVTVVGCDKNMPGALMAMIRLNRPSILVYGGTIDSGCHNGQKLDVVSAFEAWGSKVAGTMTENEYQNIVEKACPGAGACGGMYTANTMASAIEALGMTLPFNSSNPALSDAKKEESVKAGEALRVLLEKDIKPSDIITRKSLENAVRLVTILGGSTNAVLHFLAIARAAQIDFTLKDFQDISDNTPFLADLKPSGKYLMEDVHAVGGIPAVLKYLLKKGLIHGDCLTVTGKTIAENLLDVADLTEGQDVIKPIEEPIKISGHLRMLYGNLATEGSVAKITGKEGLSFKGKAKVFESEYDANDGIRDGKVEKGDVVVIRYEGPKGGPGMPEMLKPTAAIMGAGLGKDVALITDGRFSGGTHGFVVGHITPEAQEGGTLAFVEDGDIITIDAETNTISVEVSEQELQKRRKNWKAPDLKFERGVLYKYAKTVSSASKGCVTDEF

SEQ ID NO: 209 - DNA, 1704 bp, Psychroflexus torquis
ttgatttttgaaaatgaaacagatacaatggaactaaataagtatagcaaaaccgttactcaagatcctactcaaccagctgctcaagctatgctgcatgctataggtctaactaaagaagatttttttaagcctatcattggtattgctagtactggatacgaagggaatccttgtaatatgcatttaaacgatctcgctaaactcgctaaacaagggacagcaaatgaagatattataggtttaatatttaataccataggggtgagtgatggaatttctatgggcacaccaggaatgcgttactctctaccttctagggatatcatcgcagactccatggaaactgttgttcaagctatgagttatgatggtttaattactgtcgtaggctgcgataaaaacatgcccggtgcattaatagcgatgattcgactcgacagaccttgcattatgatttatggaggaaccatcgattctggttgtcataatggaaaaaaattggacgtggtttccgcttttgaagcttggggaagtaaagtggctggaaccatgcaagaagaagaataccaaagcattgtagaaaaagcgtgtcctggagctggtgcttgtggagggatgtatactgctaatacgatggcctcttctatagaagctttaggaatgactttaccttataattcttccaatccagcgcttagtccagaaaaaaaacaagagtctattaaagcaggtgaagctttgagagttttattggaaaaagacatcaaaccttcagatataattacaagaaaatctttagaaaatgccatacggttaattacaattttaggaggatctacaaatgctgttttacattttttagcaattgctagagccgctgaaattgatttcactttaactgattttcaaacgattagcgataatactccttttttagcagacttaaaaccgagtggtaagtaccttatggaagatttacatgaggtaggtggaattccagcagttttgaaatatttgcttaaaaaaggccttatttatggagactgcctaaccgttacaggaaaaactttagcagaaaatttacgtgatgtagaggatcttaaagaaggtcaggaggtcatcaaaccaatagaaagccctattaaaatctcaggacatctaagaatgctctttgggaatttagctgaagagggcagtgttgctaaaattacaggaaaagaaggtttaaaatttcgaggaaaggccaaggtttttgaaggggaatacaaagctaatgacggaattagagatggaaaagttcaaaaaggagatgtagtggttatccgttatgaaggccctaaaggaggtccaggtatgccagaaatgctgaaacctactgctgcaataatgggagcagggttaggcaaagatgtcgctttgattaccgatggaagattctctggaggaactcatggttttgtagttgggcatatcactccagaagcccaagaaggcggcacgattgcccttgttgaagaaggggattatatcactattgatgccgagacaaacagtatcaatttagaagtatctgatgaggagctcatcaaaaggaaaaaaaattggaaggcaccaaatttaaaatttaaacgaggtgttctttataaatatgcgagaatggttaattctgcatcaaaagggtgcgtaacagacgaattttaa

SEQ ID NO: 210 - protein, 567 aa, Psychroflexus torquis
MIFENETDTMELNKYSKTVTQDPTQPAAQAMLHAIGLTKEDFFKPIIGIASTGYEGNPCNMHLNDLAKLAKQGTANEDIIGLIFNTIGVSDGISMGTPGMRYSLPSRDIIADSMETVVQAMSYDGLITVVGCDKNMPGALIAMIRLDRPCIMIYGGTIDSGCHNGKKLDVVSAFEAWGSKVAGTMQEEEYQSIVEKACPGAGACGGMYTANTMASSIEALGMTLPYNSSNPALSPEKKQESIKAGEALRVLLEKDIKPSDIITRKSLENAIRLITILGGSTNAVLHFLAIARAAEIDFTLTDFQTISDNTPFLADLKPSGKYLMEDLHEVGGIPAVLKYLLKKGLIYGDCLTVTGKTLAENLRDVEDLKEGQEVIKPIESPIKISGHLRMLFGNLAEEGSVAKITGKEGLKFRGKAKVFEGEYKANDGIRDGKVQKGDVVVIRYEGPKGGPGMPEMLKPTAAIMGAGLGKDVALITDGRFSGGTHGFVVGHITPEAQEGGTIALVEEGDYITIDAETNSINLEVSDEELIKRKKNWKAPNLKFKRGVLYKYARMVNSASKGCVTDEF

SEQ ID NO: 211 - DNA, 1677 bp, Flavobacteriales bacterium
atggaattgaataaatacagtaaaaacgttacccaagaccccacacaaccagctgctcaagcaatgttgtatgccataggttttaaagatgaagattttaaaaaaccattagttggtatcgcaagtacgggatatgagggcaacccttgtaacatgcatttgaatgatttggccaaattggtcaaggacggcgtgaattcaaaggaaacggttggtttgattttcaatacaattggggtgagtgatggaatatccatgggaactcctggaatgcgtttttcattaccatcaagggatattattgccgattcaatggaaacggttgtccaaggaatgtcgtatgacgccttggtaacggtggtaggctgtgataaaaatatgccgggagcattaatggccatgttaagattgaataggccatcaatattggtatacggcggtacaattgcctctggatgtcataatgatagaaaattggatattgtttctgcttttgaagcttggggagaaaaagtggctggtaccatggaggagtctgagtataaaagtataataaggaaagcgattcctggggcaggtgcttgtggtggtatgtacacggcaaataccatggcttcagccattgaagctttgggaatgtcattgccttataattcttccaaccctgcagacaattatctcaaagagaatgaatgtattgaagcaggtaagcaaatgcgcgtacttattgagaaagatattaaaccactggacattgtaactcgtaagtcattggaaaatgcgattcgtttagttactatcatgggtggctcaacaaatgcagtattacatttcttggcaattgctagagccgcagatatagaatttacactacaagattttcaacatattagtgatacaacaccttttattgcagatttaaagccaagtggcaaatatttaatggaagatgtgcaccgtgtaggtggtataccggctgtattgaaatatttattgaaaaacggacttttacatggggattgtttaacggttactggcaagacattggctgaaaatcttgaaaatgtcccagatttagaagaggggcaagatgtaattatgcctttggacaaaccaataaaagcaaccggacatttacgcatgctttatgggaatctggcagaaaatggttcagttgcaaaaattacgggaaaagaaggtttggtgtttaaaggaactgccaaagtgtttaatagcgagtatgacgccaatgatggtattcgaactggattggtgaaaaagggtgatgttgttgtaattcgatatgaagggcctaaaggaggtcctggaatgccagaaatgttgaaaccaacagcagcaattatgggagctggtttaggaaaagaagtagccttgattacagatggtcgtttttcaggaggaacacacggttttgtagtaggacatatttcacccgaagctcaagaaggtggtacaattggtttggttaaaaatggtgacataattaccattgatgctgaaactaattcaatcaatgttgctgtttctgatgaagaattggcaaaacgaaagaccgaatgggtacaaccagaattaaaattcaaaaagggcgtgctttataaatatgcgcgttcggtttcatctgctgcggaaggttgcgtaacggatgagttttaa

SEQ ID NO: 212 - protein, 558 aa, Flavobacteriales bacterium
MELNKYSKNVTQDPTQPAAQAMLYAIGFKDEDFKKPLVGIASTGYEGNPCNMHLNDLAKLVKDGVNSKETVGLIFNTIGVSDGISMGTPGMRFSLPSRDIIADSMETVVQGMSYDALVTVVGCDKNMPGALMAMLRLNRPSILVYGGTIASGCHNDRKLDIVSAFEAWGEKVAGTMEESEYKSIIRKAIPGAGACGGMYTANTMASAIEALGMSLPYNSSNPADNYLKENECIEAGKQMRVLIEKDIKPLDIVTRKSLENAIRLVTIMGGSTNAVLHFLAIARAADIEFTLQDFQHISDTTPFIADLKPSGKYLMEDVHRVGGIPAVLKYLLKNGLLHGDCLTVTGKTLAENLENVPDLEEGQDVIMPLDKPIKATGHLRMLYGNLAENGSVAKITGKEGLVFKGTAKVFNSEYDANDGIRTGLVKKGDVVVIRYEGPKGGPGMPEMLKPTAAIMGAGLGKEVALITDGRFSGGTHGFVVGHISPEAQEGGTIGLVKNGDIITIDAETNSINVAVSDEELAKRKTEWVQPELKFKKGVLYKYARSVSSAAEGCVTDEF

SEQ ID NO: 213 - DNA, 1677 bp, unknown
  unidentified eubacterium SCB49
atggaattaaataaatatagtaaacgcgttactcaagacgattcacaacctgcagcaaaagctatgcttcatgctattggtttgagtaaagaagacttagataaaccatttgttggtattgcgagtacaggttatgaagggaatccttgtaatatgcatttaaacgatttagcgcttgaagtaaaaaaaggtacaaaaaataaagatttagtaggcctaatttacaataccattggtgtgagtgatggtatttctatgggaacacctggaatgagatattccctaccctctagagatgtaattgcagattcaatggaaacggtagtagaaggaatgtcttatgatgcacttgttacggtagtaggttgtgataaaaatatgcctggagctttaatggctatgttacgtactaaccgacctggcgttttagtttatggaggcaccattgcttctggatgtcataatggtaaaaaattagatgtcgtttctgcttttgaatcttgggggcaaaaagttgctggaaaaatagatgaaaaagaatatcaagatgtcattgaaaaggcatgtcctggtgcaggtgcttgtggtggtatgtataccgcaaacacaatggcatctgctatagaggcattaggaatggcattaccatataactcttctaaccctgctttaggaacagaaaaaaaagcagaatgcataaaagctggcgaagctgtccgtttactccttgaaaaagacattaaacctaaagatattgtcacaaaaaaagcattagaaaatgccatcaggttagtaacaataatgggaggatctacaaatgccgtgttacattttttagcgattgctagaaccactgatgttgaatttacattagaggatttccaaaaaatatctgataccactccttttttagcagatttaaaacctagtggtcagtacttaatggaagatgtccatgcggttggaggaacacctgctgttttaaaatacttattaaaaaatggcttattacatggagattgtctaactgtaacaggaaaaacattggctgaaaacctccaagatgtacccgatttattagaaaatcaaaaggttataaaatcaataaacaaccctattaaagagacagggcatttaagaatattaagaggaaatttatcaccagaaggtgctgttgcaaaaattacaggaaaagagggctttaaatttacaggtaccgcaaaagtttttgattctgaatatgacgccaatgatggcattagagatggtaaagtacaaaaaggcgatgttgtagttattagatatgaaggtcctaaaggtggtcccggaatgccagaaatgctaaagcctacagcagcaattataggagctggattaggtaatgatgtagctttaattacagatggaaggttttctggtggtacgcacggttttgtagttggtcatatttcgccagaagcacaagtaggcggtcctattgcttttgtacaaaacggagatgagataactatcgacgccattaaaaataccatagactttaatatttccgaagaagttttagaaaaacgtaaagcagcctggaaacaacccgatttaaagtataaaaaaggggttttatataaatatgccagaactgtatcatgtgcatctaaaggttgcgtaacagatgaattttaa

SEQ ID NO: 214 - protein, 558 aa, unknown
  unidentified eubacterium SCB49
MELNKYSKRVTQDDSQPAAKAMLHAIGLSKEDLDKPFVGIASTGYEGNPCNMHLNDLALEVKKGTKNKDLVGLIYNTIGVSDGISMGTPGMRYSLPSRDVIADSMETVVEGMSYDALVTVVGCDKNMPGALMAMLRTNRPGVLVYGGTIASGCHNGKKLDVVSAFESWGQKVAGKIDEKEYQDVIEKACPGAGACGGMYTANTMASAIEALGMALPYNSSNPALGTEKKAECIKAGEAVRLLLEKDIKPKDIVTKKALENAIRLVTIMGGSTNAVLHFLAIARTTDVEFTLEDFQKISDTTPFLADLKPSGQYLMEDVHAVGGTPAVLKYLLKNGLLHGDCLTVTGKTLAENLQDVPDLLENQKVIKSINNPIKETGHLRILRGNLSPEGAVAKITGKEGFKFTGTAKVFDSEYDANDGIRDGKVQKGDVVVIRYEGPKGGPGMPEMLKPTAAIIGAGLGNDVALITDGRFSGGTHGFVVGHISPEAQVGGPIAFVQNGDEITIDAIKNTIDFNISEEVLEKRKAAWKQPDLKYKKGVLYKYARTVSCASKGCVTDEF

SEQ ID NO: 215 - DNA, 1689 bp, Gramella forsetii
atggataaaacagcaatgaacaacaaatatagtagtacaataacacaaagtgattctcaacctgcctcacaggcgatgcttcacgctataggattaaataaagaagatctcaaaaaaccttttgtgggaattgggagtaccggttacgaagggaatccctgtaatatgcaccttaatgaccttgctaaagaggtgaaaaaaggaactcagaatgccgatttaaacggacttattttcaatacaataggcgttagtgatgggatttccatgggaacgccgggaatgcgattctcactgccttccagagatctaatcgcagattctatggaaactgttgtaggaggaatgtcttacgatggcctggttactgtagtgggttgcgataagaatatgcccggtgccttaatggctatgttgagactgaacaggccttctgtgctggtgtatggcggaacgatcgcttccggttgccataatggtaaaaaactggatgtggtgtctgcatttgaagcctggggctcaaaagtttcaggggatatgcaggaagaagaatatcagcaggtaattgaaaaagcctgtccgggggcaggagcctgtggagggatgtatactgcaaatacaatggcctcctctatcgaagctttagggatgagtctgccgttcaacagttccaatcctgcaaccggacctgagaaaactcaggaaagtgtaaaagcaggggaggcgatgaaatatttgctggagaatgatctaaaaccaaaagatatagtgaccgcaaaatcactggagaatgcaattcgactattaacggtgcttggtggttctaccaatgccgtacttcattttcttgcgatagcaaaagctgcagagatcaattttggattaaaagattttacaagaatatgtgaggaaacgcctttcctggcagatttgaagcctagcgggaaatacctgatggaagatattcacaggattggaggaatcccggctgtgatgaaatatatgcttgaaaaaggactgcttcatggcgaatgtatgacagttaccggaaaaacgattgccgaaaatcttgaaaatgtaaagccattacctgacgatcaggatgtaattcaccctgtcgaaaaacctatcaaagctaccggacacatcagaattttatacggaaatctggcttctgaaggctccgttgccaaaataacgggaaaagaaggattggaatttcaaggaaaagcaagagtgtttaatggtgaatttgaagctaacgaagggatttcttcgggcaaggttcaaaaaggggatgtggtcgtcattcgctatgagggtcctaaaggaggacctggaatgccagaaatgctgaaaccaacttcggccattatgggcgccggactagggaaaagtgtagcccttatcaccgacggaaggttctcgggaggaactcatggctttgtggtgggacacattactcctgaggctcagcaaggcggactcattggtctgttgaaggatggtgacgagataagtattaatgccgagaaaaatactattgaggcacatctttcagcagaagaaataaatagaagaaaagaagcctggaaagctcccgctttaaaggtgaacggaggagtactctataaatacgcaaaaacggtagcatcagcttcagaaggctgcgtaacagatgaattttaa

SEQ ID NO: 216 - protein, 562 aa, Gramella forsetii
MDKTAMNNKYSSTITQSDSQPASQAMLHAIGLNKEDLKKPFVGIGSTGYEGNPCNMHLNDLAKEVKKGTQNADLNGLIFNTIGVSDGISMGTPGMRFSLPSRDLIADSMETVVGGMSYDGLVTVVGCDKNMPGALMAMLRLNRPSVLVYGGTIASGCHNGKKLDVVSAFEAWGSKVSGDMQEEEYQQVIEKACPGAGACGGMYTANTMASSIEALGMSLPFNSSNPATGPEKTQESVKAGEAMKYLLENDLKPKDIVTAKSLENAIRLLTVLGGSTNAVLHFLAIAKAAEINFGLKDFTRICEETPFLADLKPSGKYLMEDIHRIGGIPAVMKYMLEKGLLHGECMTVTGKTIAENLENVKPLPDDQDVIHPVEKPIKATGHIRILYGNLASEGSVAKITGKEGLEFQGKARVFNGEFEANEGISSGKVQKGDVVVIRYEGPKGGPGMPEMLKPTSAIMGAGLGKSVALITDGRFSGGTHGFVVGHITPEAQQGGLIGLLKDGDEISINAEKNTIEAHLSAEEINRRKEAWKAPALKVNGGVLYKYAKTVASASEGCVTDEF

SEQ ID NO: 217 - DNA, 1677 bp, Robiginitalea biformata
atgaacctgaacaaatacagtaaaaacgtcacacaggaccccacccaaccggcagcgcaggccatgctttatgccattggcctgaccgaggaggaccttgaaaaacccctgatcgggattgccagcaccgggtatgaaggcaacccgtgcaacatgcacctgaacgatctggcgctgcacgtgaaggaaggcgtgaaccgctccgatctggtagggctgattttcaatacgatcggggtgagtgacgggatatccatgggaacctacgggatgcgttattccctcccttcccgggatattattgccgattccatggagaccgtggtccaggcgatgaactacgacggcctggtaactgtagtgggctgtgacaagaacatgcccggggcgctgatggcgatgatccgcctgaaccgcccctccgtaatggtttacgggggaaccattgcatccggttgcctgaacaaccggaaactcgatgtggtatcggcttttgaggcctggggccagaaagtggccgggaatatgcaggaggaggaatacaaacaagtaatccagaacgcctgcccgggagctggtgcctgtggcgggatgtatacggccaacacgatggcatcggctatcgaagccctggggatggccctgccttacaactcttcgaacccagccaccggttcggaaaagcaggaagattgcacccgcgccggccaggcggtgcgcaccttgctcgaaaaagatatcaagccgctcgacattattacaaaaaagtccctggagaatgccatccgcctcgtagtggtgatgggggggtccacgaatgccgtcctgcacttcctggccattgccaaggcagcgcgcgtaccgtttaccctggacgatttccagcggatcagtgacgaaacgccctttttggcagacctgaagcccagcggcaaatacctgatggaagatgtccaccgggtgggcggcgtgcctgccgtccttaaattcctgctcgctgaaggcatgctccacggggattgcctgacagttactggaaaaacccttgccgagaacctaaaggatgtcccggatctggaagccggtcaggaggttatccggcccctttccgacccgatcaagaaaaccgggcacctgcgtatcctgtacgggaacctcgcacccacaggttcggttgccaaaatcaccgggaaggagggactccggttccagggacccgcccgcgtatttgaggacgaatttgaagcaaaccggggcataggcgaaggcaaagtttcccggggggatgtggtagtcatccgctacgaaggtccccagggtgggcctggtatgcccgaaatgctcaagcccaccagtgccatcatgggggccggcctgggcaaggatgtggccctgatcaccgatggccgcttttcgggtggtacccacggatttgtagtggggcatgtaacacccgaagcacaggccggaggcccgattgccctgctccgggacggggacatcatcaccatcgacgccgaagccaatacgctttcggtagacctgagcgacgaggagctcaaccggcggcgggcagcctggaaggcccctgaactaaaggtgaagcggggcagcctgtacaaatatgccaaaacggtttcatcggcctctgaaggctgtgttaccgatgaaatttga

SEQ ID NO: 218 - protein, 558 aa, Robiginitalea biformata
MNLNKYSKNVTQDPTQPAAQAMLYAIGLTEEDLEKPLIGIASTGYEGNPCNMHLNDLALHVKEGVNRSDLVGLIFNTIGVSDGISMGTYGMRYSLPSRDIIADSMETVVQAMNYDGLVTVVGCDKNMPGALMAMIRLNRPSVMVYGGTIASGCLNNRKLDVVSAFEAWGQKVAGNMQEEEYKQVIQNACPGAGACGGMYTANTMASAIEALGMALPYNSSNPATGSEKQEDCTRAGQAVRTLLEKDIKPLDIITKKSLENAIRLVVVMGGSTNAVLHFLAIAKAARVPFTLDDFQRISDETPFLADLKPSGKYLMEDVHRVGGVPAVLKFLLAEGMLHGDCLTVTGKTLAENLKDVPDLEAGQEVIRPLSDPIKKTGHLRILYGNLAPTGSVAKITGKEGLRFQGPARVFEDEFEANRGIGEGKVSRGDVVVIRYEGPQGGPGMPEMLKPTSAIMGAGLGKDVALITDGRFSGGTHGFVVGHVTPEAQAGGPIALLRDGDIITIDAEANTLSVDLSDEELNRRRAAWKAPELKVKRGSLYKYAKTVSSASEGCVTDEI

SEQ ID NO: 219 - DNA, 1677 bp, Tenacibaculum sp.
atggaattaaataaacatagcaaaagattaacccaagacgaatctcaaccagcttctcaagccatgttgtatgcagtaggtttatcagaagaagatatgagcaaagcccaagttggtattgcaagtacaggttatgatggtaatccatgtaatatgcatctaaacaatttagctgcagaagttaaagtagaaagtaaaattgctggtttagttgggttaggttttaatactattggagtttcagacggaatttctatgggaacttctggtatgaattattctttagcttccagagatataattgcagattcaatagaaactgtaatgaatgctcaaagttatgatgccttagtttctgtggtaggttgtgacaaaaatatgccaggagctgtaattgcaatgttacgtttaaataggccatcaattatgatgtatggaggtacaattgcctctggtagttataaaggtaaaaaattaaatattgtatctgcctttgaagctttaggtcaaaaagtagctggagaaatagatgagaatgaatacaaagaaattataaaaagagccattccaggagcaggtgcttgtggaggtatgtatactgcaaatacaatggcttctgcaatagaatgtatgggttttgctttgccttataattcttctattccagcagaaaatccaaataaactatctgaagcagaaagaacagctttagctattaaaaacttattagagttagatttaaaacctttagatatcatttctaaaaagtcgttagaaaatgctgttgctttagtaaatgctttgggtggatctacaaatgcagttttacactttttagctatagcacatgcagcagaaatagattttactttagaagattttcaaaaagtatcagatagaacgcctttaattgcagatttgaaaccatcaggaaaatatttaatggaagatgttcatggagttggaggtacgcctgcaattatgaaatatttattggataatgggtatttgcatggagattgcttaactgttacaggtaaaactttagcagaaaacttggcagatgttaaagcaatggagtttgaagctcaagatgttatttatccaaaagataaagctttaaaaacgtcaggaaacattcaaatcatttatggaaatctagcaacagaaggtgcagtagctaaaatttctggaaacgaaggcttgttgtttgaaggtaaagctgtggtttacgatggtgagcaagcagcaaatacaggtatttctaatggtgaagtagaaaaaggtgatgtagttgttattagatatgtggggccaaaaggtgggccaggaatgccagaaatgttaaagccaacttctttaattatgggagcaggtttaggtaaatctgtagctttaataacagatggacgtttttctggaggtacacatggttttgttgtggggcatattacaccagaagcacaatcaggaggagctattgggcttttagaaacaggtgataaaattagaattagtgcagaagacaactcaataaatgtgcttatttctgatgaagagttagagaaaagaagagcaaattgggtggctcctgctttaaaacataaaaaaggaattttatacaagtacgcaaaatctgtagcctctgcatctaaaggatgtgttactgatttataa

SEQ ID NO: 220 - protein, 558 aa, Tenacibaculum sp.
MELNKHSKRLTQDESQPASQAMLYAVGLSEEDMSKAQVGIASTGYDGNPCNMHLNNLAAEVKVESKIAGLVGLGFNTIGVSDGISMGTSGMNYSLASRDIIADSIETVMNAQSYDALVSVVGCDKNMPGAVIAMLRLNRPSIMMYGGTIASGSYKGKKLNIVSAFEALGQKVAGEIDENEYKEIIKRAIPGAGACGGMYTANTMASAIECMGFALPYNSSIPAENPNKLSEAERTALAIKNLLELDLKPLDIISKKSLENAVALVNALGGSTNAVLHFLAIAHAAEIDFTLEDFQKVSDRTPLIADLKPSGKYLMEDVHGVGGTPAIMKYLLDNGYLHGDCLTVTGKTLAENLADVKAMEFEAQDVIYPKDKALKTSGNIQIIYGNLATEGAVAKISGNEGLLFEGKAVVYDGEQAANTGISNGEVEKGDVVVIRYVGPKGGPGMPEMLKPTSLIMGAGLGKSVALITDGRFSGGTHGFVVGHITPEAQSGGAIGLLETGDKIRISAEDNSINVLISDEELEKRRANWVAPALKHKKGILYKYAKSVASASKGCVTDL

SEQ ID NO: 221 - DNA, 1677 bp, Polaribacter irgensii
atggaattaaacaaacatagcaaaagattaacacaagatgaatctcaaccggcatcacaagcaatgttgtacgctgtaggtttaacagatgaggacatgcagaaggcgcaaattggtattgcaagtactggatatgacggaaatccttgtaatatgcatttaaatcatctaaaagaagaggttaaagtagagtgtaatattgcgggtttagtcggtttagggttcaatacaattggggtgtcagatggaatttctatgggaacttcaggcatgaattattctttagtttcaagagatatcatagcagactctatcgaaacggttatgaatgcacaaagttacgatgcagtaattgctattgtgggttgtgataaaaatatgccaggatcagtgattgccatgctgcgtttaaatcgccctgcgataatgatgtatggcggctcgactgcatcgggaaattacaaaggaaaaaagttaaatattgtttccgcttttgaggctttaggtcaaaagatgtctggagaaattgaagaagaagagtatcgagaaataattaagagggccattccaggcgctggagcgtgtggtggtatgtacactgcaaatacaatggcttctgcgattgaatgtatggggttctcattgccttataattcttcaattccggcagaaaatccgaataaattgtctgaagcggaaagaactgccttggcgattaaaaacttactagaattagatttaaaacctttagatattatttctaagaaatctttagaaaatgccattacccttgtaaatgcgttaggagggtcaacaaatgccgtcttgcatttcttagcaattgcgcacgctgcagatattgagtttactttagaggattttcaaagagtgagtgacagaacaccattaattgcagatttgaaaccatcaggaaaatatcttatggaagatgtgcataatattggaggcacacctgcgatcatgaaatatttattagaaaatgactatttgcacggggattgtttgacggttacaggaaaaacattggctgagaatttagcaaatgttaaggcgatggaatttgaagagcaagatgtgatttacccaaaagagaacgcattaaaatcatcaggaaatattcaaataatttatggaaacctagcaactgaaggagcagtagcaaaaatatctggaaacgaagggctactttttgaaggaaaagctgtcgtgtatgatggtgagcaagctgcaaatacagggattacaaatggagaggtagaaagaggagatgtcgtcgttattagatacgtgggtcctcgaggaggtccaggaatgccagaaatgctgaaacctacgtccttaattatgggtgcaggtttaggaaagtctgtagcattaattacagatggaagattttctggaggaacacatggctttgttgttggacacattacaccagaagcacaatcgggaggaaccattgggattttaaaaactggcgatacaattagaattagtgcagaagataattctattaatgttttaatttctgaggatgaaattgcagcaagaaaagtaaaatgggttgcacccgcactaaagcatacaaaaggaattttgtataaatatgcaaaaacagtagcatccgcatctaaaggatgtgtaacagacttataa

SEQ ID NO: 222 - protein, 558 aa, Polaribacter irgensii
MELNKHSKRLTQDESQPASQAMLYAVGLTDEDMQKAQIGIASTGYDGNPCNMHLNHLKEEVKVECNIAGLVGLGFNTIGVSDGISMGTSGMNYSLVSRDIIADSIETVMNAQSYDAVIAIVGCDKNMPGSVIAMLRLNRPAIMMYGGSTASGNYKGKKLNIVSAFEALGQKMSGEIEEEEYREIIKRAIPGAGACGGMYTANTMASAIECMGFSLPYNSSIPAENPNKLSEAERTALAIKNLLELDLKPLDIISKKSLENAITLVNALGGSTNAVLHFLAIAHAADIEFTLEDFQRVSDRTPLIADLKPSGKYLMEDVHNIGGTPAIMKYLLENDYLHGDCLTVTGKTLAENLANVKAMEFEEQDVIYPKENALKSSGNIQIIYGNLATEGAVAKISGNEGLLFEGKAVVYDGEQAANTGITNGEVERGDVVVIRYVGPRGGPGMPEMLKPTSLIMGAGLGKSVALITDGRFSGGTHGFVVGHITPEAQSGGTIGILKTGDTIRISAEDNSINVLISEDEIAARKVKWVAPALKHTKGILYKYAKTVASASKGCVTDL

SEQ ID NO: 223 - DNA, 1698 bp, Pedobacter sp.
atgtcaacaacaccagaattaaaccgctatagcaaaacattcactcaagatcctacacaacctgccgcacaggccatgttgtatgggattggcctaacaaaagaggacctcgacaaagcccaggtaggcattgccagcatgggttacgatggaaacacctgtaacatgcacctgaacgacctcgctcaggtggtaaaaaaaggcgtctgggacaacggaatggttggcctgaccttcagcaccatcggtgtgagtgatggaatgtctaatggtacagacggaatgcgttactccctggtatccagagatgtcatcgccgattctattgagaccatctgtggcggacagtattatgatggtgtcatcaccattcctggatgtgacaaaaatatgccgggatccatcattgccatgggacgtctgaaccgcccctcgatcatggtatatggtggaagtatccactccggaaactataaaggcaaagccctgaacattgtttctgcttttgaagcattgggtcagaaacttgccggtaacatcgaagaagaagattatcaaggcatcatccgccatacctgccctggtgcgggtgcatgtggggggatgtataccgcaaatactatggcctctgcaattgaagcaatgggcatgagtttgccttatagctcctcctaccctgctaccagtcaggagaaaaaggatgaatgtatcaatgctgccaaagcaatccgtgttttgctggagagaaacattcttccaagtgacatcatgaccgagaagtcattccacaacgccatcgtaacggtgatggtactaggtggatctaccaatgccgtactccacctgattgcaatggccaaatctgtaggcctgaacctgaagatcgatgatttccaggacgtaagtaacaatactccggtacttgccgatttaaaacctagtggtacttacctgatggaagacctgcatgaaattggtggtgttcctgcagtattaaaatatctattgaaagaaggactgttgcatggcgactgtatgacggtaacgggtaaaacccttgctgagaatgtggctgatgccgtagacctggatttcgatcagcaaaagatcatcttcccggtcagcaacccgctaaaaacaactggtcacctgcagatcctgtatggcaacattgctcaaaaaggatcagtagcaaaaatcagtggtaaagaaggcgagaaatttgaaggccctgcacgtgtatttgacggggaaaaatcgttgatcgcaggaatcctgagtggacgtgtacgccagggtgatgtggtcgtgatcagacaggtaggccctaaaggagctcctggaatgcctgaaatgctgaaaccgacatctgccatcattggcgccggactgggtaaatcggttgccctgatcactgacggaaggttctccggaggtacacatggtttcgtagtgggacacatcactcctgaagcatgggatggtggaaacatcgcctttgttaatgatgatgacatgattaccattgatgcagtcaacaataccattaacctgaagatctctgatgaggaaatggctaaacgtaaggcagaatggaaacagttgcctccgccagtgaaaagcggtgtattgtacaaatacatcaagcaggttagtgatgccagcgaaggatgtgttactgacgcctacacacattaa

SEQ ID NO: 224 - protein, 565 aa, Pedobacter sp.
MSTTPELNRYSKTFTQDPTQPAAQAMLYGIGLTKEDLDKAQVGIASMGYDGNTCNMHLNDLAQVVKKGVWDNGMVGLTFSTIGVSDGMSNGTDGMRYSLVSRDVIADSIETICGGQYYDGVITIPGCDKNMPGSIIAMGRLNRPSIMVYGGSIHSGNYKGKALNIVSAFEALGQKLAGNIEEEDYQGIIRHTCPGAGACGGMYTANTMASAIEAMGMSLPYSSSYPATSQEKKDECINAAKAIRVLLERNILPSDIMTEKSFHNAIVTVMVLGGSTNAVLHLIAMAKSVGLNLKIDDFQDVSNNTPVLADLKPSGTYLMEDLHEIGGVPAVLKYLLKEGLLHGDCMTVTGKTLAENVADAVDLDFDQQKIIFPVSNPLKTTGHLQILYGNIAQKGSVAKISGKEGEKFEGPARVFDGEKSLIAGILSGRVRQGDVVVIRQVGPKGAPGMPEMLKPTSAIIGAGLGKSVALITDGRFSGGTHGFVVGHITPEAWDGGNIAFVNDDDMITIDAVNNTINLKISDEEMAKRKAEWKQLPPPVKSGVLYKYIKQVSDASEGCVTDAYTH

SEQ ID NO: 225 - DNA, 1680 bp, Flavobacteria bacterium
atggaattaaataaatatagtaaaacaataacacaagatccttctcaacctgcttctcaagcaatgttatatggaattggtttaactgaagaacaactagcaaaaccttttataggaattgcttcaatgggttatgatggaaatacttgtaatatgcatttaaatcatttagcagctttaattaaaaaagaagttaatgctaatgatatggtgggtttaattttcaacacaattggtattagtgacggtattactaacggaactgatggaatgcgttattctctagtaagtagagaaattattgcagatagtattgaaagtgttgtttcaggtcattactatgatggtgtaatttctattcctggttgtgataaaaatatgccaggaagtattattgcaatgggaagattaaatcgtccatcgataatggtttatggtggtacaattgcaccaggaaaataccaaggtaaagatttgaatattgtttcggcatttgaagcattaggagaaaaaattgcgggtactatttctgaagaagactataaaggaattataaagaattcatgtccaggtgcaggagcttgtggcggcatgtatacggcaaatacaatggctattgctattgaagcattaggaatgagcttaccttattcaagttcaaatcctgctataagtcatgataaaatagaagaatgtgaatctgccgctggatatttaaaattattattagaaaaaaatatttgtccaaaagacattatgacgtttgaagcatttgaaaatgctattaccgttttaattgctctaggaggaagtacaaatgccgttttgcatatgattgcaatggcaaaaagtgttggagtagctataagtcaggataattttcaacgattaagcaatacaactccattaattgccgattttaaaccgggtggaaattatttaatgcaaaacctacatgaaaaaggtggtgtgccaatggttttaaaatatttgctttctaaaggaatgttacatggaaattgtattacggtaacaggtaaaactttagcagaaaatttagaagcagtaatagatattgattttaacgatcaaaatattattcgtcagatagagaatccaataaaaactacagggcatcttcaaattttatatggaaatcttgctttaaaaggttccgtagcaaaaataacaggtaaagaaggcgaattttttaaaggtccagctcgtgtttttgatggtgaaaaagaattaataaaaggtatcgaagataaaaaaataaaagctggcgatgtcgtagttatacgatatgtaggtccgaaggggggacctggaatgcccgaaatgctaaagccaacatcagccttaattggtgctggtttaggaaaaagtgttgcattaattaccgatggtcgttttagtggaggaactcatggttttgtagtaggtcatatttcacctgaagcttatgatggaggtacaattgctttagttgaagatgaagatattatagaaattaatgctgttgataataccattcatttacatgttggtgatgaagaattagcgaatagaaaaagtaaatggaatcaaccaaaattaaaagtaactaatggtgtgttattaaagtatgcaaaattagttacagatgcttcaaatggttgtgtaaccgatgaatattag

SEQ ID NO: 226 - protein, 559 aa, Flavobacteria bacterium
MELNKYSKTITQDPSQPASQAMLYGIGLTEEQLAKPFIGIASMGYDGNTCNMHLNHLAALIKKEVNANDMVGLIFNTIGISDGITNGTDGMRYSLVSREIIADSIESVVSGHYYDGVISIPGCDKNMPGSIIAMGRLNRPSIMVYGGTIAPGKYQGKDLNIVSAFEALGEKIAGTISEEDYKGIIKNSCPGAGACGGMYTANTMAIAIEALGMSLPYSSSNPAISHDKIEECESAAGYLKLLLEKNICPKDIMTFEAFENAITVLIALGGSTNAVLHMIAMAKSVGVAISQDNFQRLSNTTPLIADFKPGGNYLMQNLHEKGGVPMVLKYLLSKGMLHGNCITVTGKTLAENLEAVIDIDFNDQNIIRQIENPIKTTGHLQILYGNLALKGSVAKITGKEGEFFKGPARVFDGEKELIKGIEDKKIKAGDVVVIRYVGPKGGPGMPEMLKPTSALIGAGLGKSVALITDGRFSGGTHGFVVGHISPEAYDGGTIALVEDEDIIEINAVDNTIHLHVGDEELANRKSKWNQPKLKVTNGVLLKYAKLVTDASNGCVTDEY

SEQ ID NO: 227 - DNA, 1677 bp, Flavobacterium psychrophilum
atgaacacaataaacaaatacagtaaaaccataacgcaagacgaaacccaaccagcagcacaagccatgctttatggaatagggttaacggaagcagatatgtataaagcacaagtaggaattgtaagtacaggttatgaaggtaatacttgcaatatgcacttgaacgatttagccaaagacgtaaaatttggagttgcatctgaaaatttagtcggattaatatttaatactataggcgtaagcgatggtatctctaacggtacagatggtatgcgattttcattggtatctcgagacataattgcagactctatagaaacagtggttagtgcacaatggtacgatgccgttttagccgtagtgggatgtgataaaaatatgcctggatctgtcatggctatgggaagactaaatcgacctgctataatgatatatggtggtagtattcattctggaaaatggaaaggagaatccttaaatattgtgtcggcttttgaagctttgggaaaaaaatttaacaatacaataaccccagaagattttaaaggtgttataaaaaacgcttgtccaggtgcaggtgcttgtggcggaatgtacaccgcaaacaccatggcttccgcaattgaagctttgggaatgagcttaccatatagttcgtctaatccagctttgagccaagaaaagaaacaagaatgtttagatgcaggcaaagcaatccgagttttattagaaaaagacatcaaacctaaagacatcatgaccaaaaaagccttcgaaaatgcaatgacgatggtggtggttcttggtgggtctacaaatgccgttttgcatttaatagccatggcacattcagtagatatagaattaaccctgcaagacttccaaaaaacaagtaacaacattcctgttttagcagatttaaaaccaagcggaaaatacctcatggaagatttacacgcagtgggaggggttcctgcggttatgaaatatttgctagaaaacaagctgttacacggtgattgcttaacagtaacagggaaaacagtagccgaaaatttagcaaatatccctagtttacatcaaggacaaactgtttttcttcctctaaaaacgccactaaaagccacaggacatttgcaaatcctttacggaaacctagcgccagaagggagtgttgcaaaaataagcggcaacgaaggtgatttctttgaagggaaagccaaagtttataatgatgaatataccgtgattgatggcgtaaaaaacggagaggttgcctctggagatgtagttgtaattagatattgcggaccaaaaggaggaccgggaatgccagaaatgctaaaacctacttccgcaataatgggagctggtttaggaaaaaatgtagcattaataaccgacggaagattctcggggggaactcatggttttgtagtggggcatattacacctgaagcttacgacggaggaaccattgcgctagtaaaagatggtgatacaattaccattaatactaaaaataacaccattcaattaaaagttagcgaagaagaattaaccaaaagaaaatccgaatggaaacaacctaaacttaaagctaccaaaggtgttttgtataaatatgcccaatgtgtttcaagtgcatctaaaggttgtgtaaccgataattaa

SEQ ID NO: 228 - protein, 558 aa, Flavobacterium psychrophilum
MNTINKYSKTITQDETQPAAQAMLYGIGLTEADMYKAQVGIVSTGYEGNTCNMHLNDLAKDVKFGVASENLVGLIFNTIGVSDGISNGTDGMRFSLVSRDIIADSIETVVSAQWYDAVLAVVGCDKNMPGSVMAMGRLNRPAIMIYGGSIHSGKWKGESLNIVSAFEALGKKFNNTITPEDFKGVIKNACPGAGACGGMYTANTMASAIEALGMSLPYSSSNPALSQEKKQECLDAGKAIRVLLEKDIKPKDIMTKKAFENAMTMVVVLGGSTNAVLHLIAMAHSVDIELTLQDFQKTSNNIPVLADLKPSGKYLMEDLHAVGGVPAVMKYLLENKLLHGDCLTVTGKTVAENLANIPSLHQGQTVFLPLKTPLKATGHLQILYGNLAPEGSVAKISGNEGDFFEGKAKVYNDEYTVIDGVKNGEVASGDVVVIRYCGPKGGPGMPEMLKPTSAIMGAGLGKNVALITDGRFSGGTHGFVVGHITPEAYDGGTIALVKDGDTITINTKNNTIQLKVSEEELTKRKSEWKQPKLKATKGVLYKYAQCVSSASKGCVTDN

SEQ ID NO: 229 - DNA, 1674 bp, Flavobacterium johnsoniae
atggaattaaataagtacagcaaaaccatcactcaagatcaaacacagcctgcggcgcaagcaatgttgtatggaattggtttaactgaagaagatttaaaaaaagcacaagttggtattgtcagcatgggttatgatggtaatacttgcaatatgcacttaaatgatttagcaaaagatgttaaaaaaggtgtttgggatgctggtctggtcggacttatttttaataccattggtgtaagtgacggaatttctaacggtacagaaggaatgcgttattcattagtttctcgtgatgtaatcgcagattctattgaaactgtagccggtgcacaatggtacgatagtattattgcaattcctggctgcgataaaaatatgcctggagcattaatcgcaatgggaagattaaaccgtccgtcaatgatggtttatggaggatctatccactcaggaaaatggaaaggtgaatctctaaacatcgtttctgcttttgaagctttaggaaaaaaagtaaaaggcgaaattactccggaagattttaaaggtgttattcaaaatgcttgtcctggagctggtgcctgcggtggtatgtatactgcaaacactatgtcttctgcaattgaagcattaggtatgagtatgccttacagttcttctaaccctgctttgagtcaggaaaaaagagacgaatgtattgctgccggagaagctattaaagttttattagaaaaagatattaagccaagagatattatgactcgtaaagctttcgaaaatgctattacaattgtagcagttttaggaggttctacaaacgcagttatgcacttaattgcaatggcacactctgttggtattacaattactcttgatgattttcaggcaattaacgacagaacacctgttcttgccgatatgaaaccaagtggtaaatatatgatggaagacattcacgaagtgggaggtattccgggtgtaatgaaatatttattgaaagtgggacttatccacggagattgtttaacagtaactggaaaaacagttgctgaaaacttagcttctacaccggatttacaagacggacaagaagtaattcatgaaattcaaaaagcgttaaaaccaacaggaaatattcaggttttatacggaaaccttgcttctgaaggagctgtggcaaaaatcagcggaaaagaaggggaatatttcgaaggaccagctgttgtatttgaaggggaatttgaagtaattccaggcttgcaggccggaaagattaaaccaggtaatgtcgtcgtcattagaggttgtggaccaaaaggtggtccgggaatgcctgaaatgctaaaaccgacatctgccattattggtgcaggattaggaagcagctgtgcacttattacagacggcagattctccggaggttcacacggattcgtggtaggacacgtaacaccagaggcttatgatggaggtggtattgcactagtaaaagatggagatttaattgctatcgatgctgtaaaaaatacaatcgacctgaaaatatctgacgaagaatttgcagctcgtaaagcggcttgggttcaaccagcgctaaaagttgacagaggggttttacttaaatacgcaagatcggtttctagtgcttcaacaggctgtgttaccgataattaa

SEQ ID NO: 230 - protein, 557 aa, Flavobacterium johnsoniae
MELNKYSKTITQDQTQPAAQAMLYGIGLTEEDLKKAQVGIVSMGYDGNTCNMHLNDLAKDVKKGVWDAGLVGLIFNTIGVSDGISNGTEGMRYSLVSRDVIADSIETVAGAQWYDSIIAIPGCDKNMPGALIAMGRLNRPSMMVYGGSIHSGKWKGESLNIVSAFEALGKKVKGEITPEDFKGVIQNACPGAGACGGMYTANTMSSAIEALGMSMPYSSSNPALSQEKRDECIAAGEAIKVLLEKDIKPRDIMTRKAFENAITIVAVLGGSTNAVMHLIAMAHSVGITITLDDFQAINDRTPVLADMKPSGKYMMEDIHEVGGIPGVMKYLLKVGLIHGDCLTVTGKTVAENLASTPDLQDGQEVIHEIQKALKPTGNIQVLYGNLASEGAVAKISGKEGEYFEGPAVVFEGEFEVIPGLQAGKIKPGNVVVIRGCGPKGGPGMPEMLKPTSAIIGAGLGSSCALITDGRFSGGSHGFVVGHVTPEAYDGGGIALVKDGDLIAIDAVKNTIDLKISDEEFAARKAAWVQPALKVDRGVLLKYARSVSSASTGCVTDN

SEQ ID NO: 231 - DNA, 1713 bp, Lactococcus lactis
atggaattcaaatataacggaaaagttgaatcaatagagctcaataagtattcaaaaacattgacacaagacccaacacagccagcgacccaagccatgcactatggcattggttttaaagatgaggacttcaaaaaagctcaggtcggaatcgtcagcatggattgggacggaaatccctgtaacatgcacttgggcacactcggtagtaaaatcaaaaattctgtcaatcaaactgacggactgattgggcttcaatttcacacgattggggtttctgacggaattgccaacggaaagcttggcatgagatattccttggtcagtcgtgaagttattgctgacagtattgaaaccaacgctggcgccgaatattacgatgcaattgtcgctgttcccggttgtgacaaaaatatgccaggctcaatcattggcatggctcggctcaatcgtccgtcaattatggtttatggtggaacgattgaacatggcgaatacaaaggcgaaaagttaaatattgtttcggcttttgaagcgcttggacaaaaaatcactggaaatatttccgaggaagattatcacggcgtcatttgtaatgccattccgggacagggtgcttgtgggggcatgtatacagcaaatacactggcttcggcaattgaaactttgggaatgagtttgccttattcggcttcaaatccagcggtcagtcaagaaaaagaagacgaatgtgatgaaattggtctggcaatcaaaaatttgctagaaaaagacatcaaaccaagcgatatcatgaccaaggaagcttttgaaaatgccataacgatcgtcatggttctcggtggttcaactaatgctgtgcttcatatcattgccatggctaatgccatcggtgtcgaaattacgcaagatgattttcaacgtatttccgatgtcacgcctgtgcttggcgacttcaagccaagtggcaagtacatgatggaagatttgcacaaaattggtggcgtgcctgctgttttgaaatatttgctcaaagagggcaagcttcatggcgactgtttgacagttactggtaaaactctagctgaaaatgttgaaacagcactggatttggactttgacagccaagacattattcgaccacttgaaaatcctatcaaagcaacaggtcatttgcaaattctctatggcaatcttgctgaaggtggttctgtggcaaaaatttctggaaaagaaggggaatttttcaaaggaacagctcgtgtctttgatggcgaacaacattttattgacggaattgagtcaggtcgtttgcacgcaggagatgtcgctgtcattcgtaatatcggtccagtcggaggcccaggaatgccagaaatgttaaaaccgacctcagccttgattggagcaggtcttggaaaatcttgtgctttgattactgacggacgtttctctggtggcacacatggctttgtggttggccacattgtccccgaagcggttgagggtggattgattggcttggtcgaagatgatgatattatcgagattgatgcggtcaataacagcattagtttgaaagttgctgacgatgagattgctagacgacgtgccaattatcaaaaacctgctcctaaagcaacgcgtggggttcttgctaaatttgctaaactcacgcgcccagccagtgaaggctgtgtgactgatttatag

SEQ ID NO: 232 - protein, 570 aa, Lactococcus lactis
MEFKYNGKVESIELNKYSKTLTQDPTQPATQAMHYGIGFKDEDFKKAQVGIVSMDWDGNPCNMHLGTLGSKIKNSVNQTDGLIGLQFHTIGVSDGIANGKLGMRYSLVSREVIADSIETNAGAEYYDAIVAVPGCDKNMPGSIIGMARLNRPSIMVYGGTIEHGEYKGEKLNIVSAFEALGQKITGNISEEDYHGVICNAIPGQGACGGMYTANTLASAIETLGMSLPYSASNPAVSQEKEDECDEIGLAIKNLLEKDIKPSDIMTKEAFENAITIVMVLGGSTNAVLHIIAMANAIGVEITQDDFQRISDVTPVLGDFKPSGKYMMEDLHKIGGVPAVLKYLLKEGKLHGDCLTVTGKTLAENVETALDLDFDSQDIIRPLENPIKATGHLQILYGNLAEGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVADDEIARRRANYQKPAPKATRGVLAKFAKLTRPASEGCVTDL

SEQ ID NO: 233 - DNA, 1686 bp, Psychromonas ingrahamii
atgtcagaaataaataagtattcaaaaacagtgacgttagatgaatcacaaccggcttcacaggccatgctttatgctattggtttgaaagaagaggatatgaaaaaagcgcaagtgggtattgtttcaacaggatgggaaggaaatccatgcaatatgcacttaaacgaatttgctaaagacgtgaaaaaaagtgtgaacgcagctgatttggtgggattaatctttcacacaatcggagtgagtgatggtatttcaaacgggactaccgggatgaagtactctttagtgtctcgtgagatcattgctgattctattgaaacggttgtaagtgcgcaattttatgatgcgattgttgccattgtaggatgtgataaaaatatgcccggtgcaatgatggcattgtcgcgtttaaatcgtccgggaatattggtttatggcggttcggttaaagctggaaaatggaaaggtgaagacttgaatatcgtttctgctttcgaagcttatggaaaaaaattacagggtgttatctcccatgaagattataaaggggtaattcaaaatgcgatcccgggtccgggtgcttgtggtggaatgtatacggcaaatactatgtcttcagctattgaagcgttaggcatgagtttgccttactcttcatcgaacccggcggttagcgatgacaaaaaaagagaattaacaacagtgggtgatgcagttaaaaacctgctggaaaaagatattaaaccaaaagatattatgaccaaaaaagcgttcgagaatgccttaagaattattatgattttagggggctctaccaatgcaactttacatatgattgcaatggcccgatcatcaggtgttgacttgagtttagatgatttccaaaagatggcagataaaacgccattattggcaaatttaaaaccttccggggaattcctaatgcaagacttacatgaaatcggcgggatccctgcagtcatgaaatacttattggctgaaggtttattacatggggattgtttgaccgttacaggtaacaccattgctgaaaacttagctgatttacccggccttcctgatgatcaggacattatcagacctttgtctaaccccttgaaagaaactggccacttacagattctttatggaaacttggcacctgaaggttcagttgcaaagattacaggtaaagaaggcgaagtattcgaaggcccggcaagagtttatgaagatgaattttcagcaataaaaggtatcggagacgaagtgcaaaaaggtgaagttatcgttatccgttattcaggaccaaaaggtgcgcctggcatgccagaaatgctaaaaccaacttcagctgtaatgggggcgggtcttggaaaagacgtggcattaattacagatggcagattctccggaggttctcatggttttgttgttggacacgtgacgccagaggcatcggaaggtggattgattgccctggtccaaaatggagacatgatccgaattgattctgttactaacaaattggaattgaaagtcgatcaggctgaaatcaacaagcgtaaagctgcttggataaaaccagcttacagagcgacaaatggtgtactaagaaagtatatcgccacggtaaaatctgcctctctaggatgtgttaccgatgaaatagacgaactgtag

SEQ ID NO: 234 - protein, 561 aa, Psychromonas ingrahamii
MSEINKYSKTVTLDESQPASQAMLYAIGLKEEDMKKAQVGIVSTGWEGNPCNMHLNEFAKDVKKSVNAADLVGLIFHTIGVSDGISNGTTGMKYSLVSREIIADSIETVVSAQFYDAIVAIVGCDKNMPGAMMALSRLNRPGILVYGGSVKAGKWKGEDLNIVSAFEAYGKKLQGVISHEDYKGVIQNAIPGPGACGGMYTANTMSSAIEALGMSLPYSSSNPAVSDDKKRELTTVGDAVKNLLEKDIKPKDIMTKKAFENALRIIMILGGSTNATLHMIAMARSSGVDLSLDDFQKMADKTPLLANLKPSGEFLMQDLHEIGGIPAVMKYLLAEGLLHGDCLTVTGNTIAENLADLPGLPDDQDIIRPLSNPLKETGHLQILYGNLAPEGSVAKITGKEGEVFEGPARVYEDEFSAIKGIGDEVQKGEVIVIRYSGPKGAPGMPEMLKPTSAVMGAGLGKDVALITDGRFSGGSHGFVVGHVTPEASEGGLIALVQNGDMIRIDSVTNKLELKVDQAEINKRKAAWIKPAYRATNGVLRKYIATVKSASLGCVTDEIDEL

SEQ ID NO: 235 - DNA, 1677 bp, Microscilla marina
atgacagttttgaacaaatacagccgacgaattactcaggatgtaacccaaccagcctctcaagcaatgctgtatggcatagggcttactaaagaggatatgagcaagcctcaaataggcatagtaagtactggttatgagggcaatacctgcaacatgcacctcaatgatctggccttggaaaccaaaaaaggtactaaagaagcagacttggtagggttggtattccatactataggcgtaagcgacggaatatctaacggtaccgaaggaatgcgtttttcgttgccttcacgcgacattatcgccgactcgatagagactgtagtgcaggctcaatggtacgatgggatacttgctgtagtgggttgcgacaaaaacatgccgggagctatgatggctctggcgcgtttgaaccgtcctggactgcttgtttacggcggaagcatcaggtcaggctgtcacaaaggtcaaaaactcaatattgtgtctgcctttgaagcactcggacagcgttttaacggaagtttgaatgaagaagattatcaaggaattatccaaaactcttgccctggtgcaggagcttgtggcggtatgtatactgccaacacgatggcaacagtgatagaagctattggattgggcttaccttatggagcctctaatcccgcccaaagccctgaaaaacaacaagaatgtatagatgcgggcaaagctatgagaaagctgctcgaagaggacatcaaacccctcgacatattgaccaaaaaagcttttgaaaatgccttgacaatgatcatggtcatgggaggctctaccaatgcggtgctgcacatgattgccattgccaaagctgctgaggtggatctaagcctggaagattttcaacgtatcagcgacaaaactccttatttggcaaatctcaagcctagtggaaagtacttgatggaagacttgcacaccattggtggcacccctgctgtaatgaagctattgctggacgagggattgctacacggtgattgtttgacggtaacgggcaaaacgcttgctgagaatcttgctaacattgctccggtaaaagacgatcaggacgtgctgttcccaataagccaacctctaaaacctcagggacatttacaagtgttatttggcaacctggccacacaaggggcagtagctaaaattacgggcaaagagggagaaaaatttgaaggtactgccaaggtgtacgacggagagtttgaggctatcaaaggtattcaggacggagaagtaaaagctgggcacgtggtagtcattaggtacgaaggccccaagggtggtccgggaatgcctgaaatgctcaagcctacctctgcaataatgggtgccgggctgggcaatagcgtggcattgattacagatggtaggttttcgggtggttcacacggttttgtagtgggacacgtgtgccctgaagcacaggaaggtggcttgattgccttgcttaaggatggcgatcgaatcacgattgatgcggtagacaaccaaatggtggcgcacttatcagaggaagaaatagcccaacgacgcgcccaatggcaagcaccagaatcgcgctttacccgtggaattttaggcaaatatgcccgtactgtttcgtcggcctcggagggctgtgtaacggatgaatag

SEQ ID NO: 236 - protein, 558 aa, Microscilla marina
MTVLNKYSRRITQDVTQPASQAMLYGIGLTKEDMSKPQIGIVSTGYEGNTCNMHLNDLALETKKGTKEADLVGLVFHTIGVSDGISNGTEGMRFSLPSRDIIADSIETVVQAQWYDGILAVVGCDKNMPGAMMALARLNRPGLLVYGGSIRSGCHKGQKLNIVSAFEALGQRFNGSLNEEDYQGIIQNSCPGAGACGGMYTANTMATVIEAIGLGLPYGASNPAQSPEKQQECIDAGKAMRKLLEEDIKPLDILTKKAFENALTMIMVMGGSTNAVLHMIAIAKAAEVDLSLEDFQRISDKTPYLANLKPSGKYLMEDLHTIGGTPAVMKLLLDEGLLHGDCLTVTGKTLAENLANIAPVKDDQDVLFPISQPLKPQGHLQVLFGNLATQGAVAKITGKEGEKFEGTAKVYDGEFEAIKGIQDGEVKAGHVVVIRYEGPKGGPGMPEMLKPTSAIMGAGLGNSVALITDGRFSGGSHGFVVGHVCPEAQEGGLIALLKDGDRITIDAVDNQMVAHLSEEEIAQRRAQWQAPESRFTRGILGKYARTVSSASEGCVTDE

SEQ ID NO: 237 - DNA, 1689 bp, Cytophaga hutchinsonii
ttgattattgtgagtacagaattaaataaaataagtaaacgtttaacccaggatccatctcagcccgcatctcaggcaatgatgtatggagctgggtttacagacgaggatatgaaaaagccaatcgttggtattggcagtacaggtttcgatggtaacacatgtaacatgcacttaaatatccttgccggacaagttaaaggcagtattacgcgtggcggtatggttggacttggtttcaacacgatcggcgtaagtgatgggatttcaatgggtacagaagggatgcgtttctctcttgtatcacgcgacgtaattgcggattcaattgaaacaatttgtgaagctcattactacgatgcgttggtaaccgttgtaggttgtgataaaaacatgcctggcgcacttattgcaatggctcgcttgaatcgcccgtcaatcatggtatacggcggtacaattcactcaggtcactacaaaggcgaaaaactaaacatcgtttcagcttttgaagcattgggtaaaaaagtagccggcacaatcactgaagaagattaccagggtgtaattaaaaatgcatgtccgggtgcgggtgcctgtggtggcatgtacacagcaaacacaatggcatctgcaattgaagcaatgggattaacacttccttattcttcaacggcacctgcaacaagcgaaaagaaaaaggcagaaacattggcgcttggcaaagcaatgatgcatctgctggagaaagatatcaagccgcgtgatatcatgacattcgaggcatttgaaaatgctatccgtgtgatcctggtattgggtggttctacaaatgcggtaatgcacttaattgcaattgcaaaagctgcgggtgttaaattaacgatcgatgattttcaacgcatcggtaatacaacaccgttactggcagatttaaaaccaagcggcaagtatatgatggaagatatggacgctattggcggcgtaccttctgtaatgcgtttgttggcaaaacataatttacttcatttagattgtatgactgtaacaggtaaaactgttggagagaatttaaaagaagctcaggatcttcctacggatcaggatctgatgtatgcatgggaaaacccgatcaaacaaacaggtcacttacagattctgtatggcaatcttgcaccacaaggttctgtggcaaagattaccggtaaagaaggaacatactttgaaggtcctgcacgcgtgtacgactctgaagaggctgtaaacaaaggtttagaggctaatgaagtaaaatcaggtgaagtaattgtaatccgttatgttggtccgaaaggcggcccgggcatgcctgaaatgttgaagccaactgctctattaatgggcttaggtttaggcaacgaatgtgccttaatcacagacggacgtttctctggcggtacacatggtttcgtagttggccacattacaccggaagcaacagaagggggtatgattggccttgtaaaaaatggcgacatcatccgtattgatgcagtaaacagagtcctagaagttaaaatttccgaggaggaagtaaccaaacgccgtgcggcatgggtaaaacctgcgccaagagctacatccggcgtgttatataaatacatgaaattagtatcttctgcatctgagggatgcgttaccgataattaa

SEQ ID NO: 238 - protein, 562 aa, Cytophaga hutchinsonii
MIIVSTELNKISKRLTQDPSQPASQAMMYGAGFTDEDMKKPIVGIGSTGFDGNTCNMHLNILAGQVKGSITRGGMVGLGFNTIGVSDGISMGTEGMRFSLVSRDVIADSIETICEAHYYDALVTVVGCDKNMPGALIAMARLNRPSIMVYGGTIHSGHYKGEKLNIVSAFEALGKKVAGTITEEDYQGVIKNACPGAGACGGMYTANTMASAIEAMGLTLPYSSTAPATSEKKKAETLALGKAMMHLLEKDIKPRDIMTFEAFENAIRVILVLGGSTNAVMHLIAIAKAAGVKLTIDDFQRIGNTTPLLADLKPSGKYMMEDMDAIGGVPSVMRLLAKHNLLHLDCMTVTGKTVGENLKEAQDLPTDQDLMYAWENPIKQTGHLQILYGNLAPQGSVAKITGKEGTYFEGPARVYDSEEAVNKGLEANEVKSGEVIVIRYVGPKGGPGMPEMLKPTALLMGLGLGNECALITDGRFSGGTHGFVVGHITPEATEGGMIGLVKNGDIIRIDAVNRVLEVKISEEEVTKRRAAWVKPAPRATSGVLYKYMKLVSSASEGCVTDN

SEQ ID NO: 239 - DNA, 1764 bp, Rhodopirellula baltica
ttgaccctttcaaggtgttgccacccatcttcggccgctttcccctgccaaaacgatctcatgaccgcgtctcagcctgaatccgattccaatgcactgaacaagtacagcagcaagatcacccagccgaaaagccagggtgcgtcgcaggcgatgctttacgccaccggcatgtcctcggaggatatgaacaagcctcaagtcggcatcggcagcatgtggtacgagggcaacagctgcaacatgcacctgctcgatctcgcagcggatgttaaagctggagtcaccgacgccggaatggtcggaatgcgtttcaacaccatcggtgtctcggacggcatctcgatggggaccgacgggatgagcttctcactgcaaagtcgcgacctgatcgccgactcgatcgagacgatcatgggggcgcagtggtacgacgcgttgatcaccctgcccggctgcgacaagaacatgcccggctgtttgatggcgatgggacgtctgaaccgtccttccatcatggtctacggtggaacgattaaacctggcagctaccgcgacgagaagctggacatcgtcagcgcgttccagtgctacggccagttcatcgcgggacaaatcagcgaagaagaacgcagtgaaatcgttcgccgcagttgcccaggtgcgggagcatgcggcggcatgtacaccgccaacacgatggccaccgcaatcgaagccttgggcatggccctgccctactccgccagcatccctgcagagcatccagaaaagaaagaggaatgcaaacgtgccggtttggccatcctcgaactgttgaagaaggacatcaagcctcgcgacatcatgactcgcggtgcattcgaagacgcgatggtgacattgatggcactgggcggcagcaccaacgcggtgcttcacttgatcgcgatggctcgcagcgtcgatgtgccactgacgattgaagacttccaatcggtcagcgaccgcacacctttcttggccgacctgaaacccagcggcaagttcgttcaagaagacctgcacagcgtcggtggcacgcccgcggtgatgaagtacttgctcgaaaagggcatgatcaaaggcgagcacatgaccgtcaccggcaagactctcgcggagaacctggccgatttgcctggtttgaagaccggccaaaagatcgtgtcgacggtcgaagagccgatcaaaaaatcgggtcacattcgaatcctgaaaggatcactggccacggaaggcgcggtcgcgaaaatcactggcaaagaaggtctgcagttcagcggaccggctcgtgtctatgacaatgaggaattgatgctcgccgctttggaacaaaagcagattcaaaagggtgacgtcgttgtgatccgctacgaaggtcccaagggcggacccggcatgcctgagatgttgactccaaccagtgccatcatgggtgctggtttgggaagcgacgtcgcgatgctgactgacggccgtttcagcggcggtagtcacgggttcatcgtggggcacatcactcccgaagcacaagttggtggtccgatcgcattgatcgaagatggagacacgatcacgattgatgccgaaaccaactcgttggacttagaagtcgatgcggctgaattggaagcccgccgatccaagtggaccgcaccgccactgaaagccacccgcggaacgctctacaagtacatcaagtgcgtgaagagcgccagcgaaggctgcgtcaccgacgagtga

SEQ ID NO: 240 - protein, 587 aa, Rhodopirellula baltica
MTLSRCCHPSSAAFPCQNDLMTASQPESDSNALNKYSSKITQPKSQGASQAMLYATGMSSEDMNKPQVGIGSMWYEGNSCNMHLLDLAADVKAGVTDAGMVGMRFNTIGVSDGISMGTDGMSFSLQSRDLIADSIETIMGAQWYDALITLPGCDKNMPGCLMAMGRLNRPSIMVYGGTIKPGSYRDEKLDIVSAFQCYGQFIAGQISEEERSEIVRRSCPGAGACGGMYTANTMATAIEALGMALPYSASIPAEHPEKKEECKRAGLAILELLKKDIKPRDIMTRGAFEDAMVTLMALGGSTNAVLHLIAMARSVDVPLTIEDFQSVSDRTPFLADLKPSGKFVQEDLHSVGGTPAVMKYLLEKGMIKGEHMTVTGKTLAENLADLPGLKTGQKIVSTVEEPIKKSGHIRILKGSLATEGAVAKITGKEGLQFSGPARVYDNEELMLAALEQKQIQKGDVVVIRYEGPKGGPGMPEMLTPTSAIMGAGLGSDVAMLTDGRFSGGSHGFIVGHITPEAQVGGPIALIEDGDTITIDAETNSLDLEVDAAELEARRSKWTAPPLKATRGTLYKYIKCVKSASEGCVTDE

SEQ ID NO: 241 - DNA, 1683 bp, Blastopirellula marina
atgtccgccccgctcaacaagtacagcagccgcgttacccagccaaaaagccagggcgcgtcgcaggccatgctttacggaaccggcatgaccgacgccgacatggacaaagcgcaggttggcatcgccagcatttggtacgagggcaacacgtgcaacatgcacctgaatcagctctcggaagtggtgaaaaaaggggtggtaggcgccgacatggtcgggatgcggttcaacacgatcggcgtgagcgacggcatctcgatggggaccgaagggatgagcttctcgctccaatctcgcgacctgatcgccgactcgatcgaaacggtcatgggcggtcagtggtacgacggactgatcgcgctgccgggctgcgacaaaaacatgccgggatgtttgatcgcgatggggcgtttgaaccgtccgtcgatcatggtctacggcggtacgatcaaaccgggccacaccagcaagggagagaagctcgacatcgtctcggctttccagtgctacgggcaattcctctcggaaggaatcaccgaagaagaacgcaaagaaatcgtgcacaaagcttgtcctggagcgggcgcttgcggcggcatgtacaccgccaacacgatggcgacggcgatcgaagcgatgggcatgacgctgccttacagcagcagcattccggccgaagatccggcgaagcagcaagaatgcatcgacgccggcaaagcgatgcgctacttgctggagaaagatattaagccgcgcgacatcatgacccgtgatgcgtttgaaaacgcgatggtcacggtgatggcgctcggcggttcgaccaacgccgtgttgcacttgatcgcgatggctcgcgcggtggatgtcgacctgtcgatcgacgacttccaaacggtcagcgatcgcgtccctttcttggccgatctgaagccgagcggcaagtttgtgcaagaagatctgcactcgatcggcggtacgccggccgtcctgaagtatctgctggccgaaggcttcttgaagggggactgtatgacggtgaccggcaagacgctggccgaaaacatcgccgatcttcccggcttgaaagaaggccagaagatcgtccacccactgtcggacccgatcaagtcctccggtcacatccagatcttgaagggcacgctggcccccgaaggcgccgtcgccaagatcaccggcaaagaaggactccgctttcaagggccggccaatgtctttgatagcgaagaagacatgttgcacgcgctggaagacaagaagatcaaaaagggagacgtcgtcattattcgctacgaaggtcccaagggaggccccggcatgccggagatgctgactccgacctcggcgattatgggggccggtctcggcagcgatgtcgcactgctgaccgatggccgcttctccggcggctcgcacggtttcatcgttgggcatatcacgcctgaggcgcaagacggaggcccggtcgcgctcgttcaaaatggcgacatcgtcacgatcgacgccgacaccaactcgattgacgtcgacgtgccggccgatgagatggcgaaacgcttggccgcttggaaggctccggcctacaaagcgacccgcggcacgctttacaagtacatcaagaatgtgaaaagcgcttcagaaggttgcgtgaccgacgaataa

SEQ ID NO: 242 - protein, 560 aa, Blastopirellula marina
MSAPLNKYSSRVTQPKSQGASQAMLYGTGMTDADMDKAQVGIASIWYEGNTCNMHLNQLSEVVKKGVVGADMVGMRFNTIGVSDGISMGTEGMSFSLQSRDLIADSIETVMGGQWYDGLIALPGCDKNMPGCLIAMGRLNRPSIMVYGGTIKPGHTSKGEKLDIVSAFQCYGQFLSEGITEEERKEIVHKACPGAGACGGMYTANTMATAIEAMGMTLPYSSSIPAEDPAKQQECIDAGKAMRYLLEKDIKPRDIMTRDAFENAMVTVMALGGSTNAVLHLIAMARAVDVDLSIDDFQTVSDRVPFLADLKPSGKFVQEDLHSIGGTPAVLKYLLAEGFLKGDCMTVTGKTLAENIADLPGLKEGQKIVHPLSDPIKSSGHIQILKGTLAPEGAVAKITGKEGLRFQGPANVFDSEEDMLHALEDKKIKKGDVVIIRYEGPKGGPGMPEMLTPTSAIMGAGLGSDVALLTDGRFSGGSHGFIVGHITPEAQDGGPVALVQNGDIVTIDADTNSIDVDVPADEMAKRLAAWKAPAYKATRGTLYKYIKNVKSASEGCVTDE

SEQ ID NO: 243 - DNA, 1692 bp, Planctomyces maris
atgtcagccgattcgcaacccgttttgaacaagtacagttcccgtatcacacagccccgttcgcagggtgcctcgcaagccatgctctacgccaccggcatgagcgaagaggatatgaacaaggcccaggtcggaatttccagcgtctggtacgaaggcaattcctgcaacatgcacctcaacaaactggctgccaaggtcaaagagggcgtcgaagccgccgatctggttggcctgcggtttaataccatcggtgtgagcgacgggatttccatgggcaccgacggcatgtcctattcgctgcagtcccgcgacctgatcgccgacagtatcgaaacagtcacctgtgcccagtggtacgatgccaacatttcgctgcctggctgtgataagaacatgcctggctgcctgattgccatgggacgatttaaccgcccctcgatcatggtttacgggggaacgattgctcccggctgtctgaataatcagaagctggacattgtctccgcatttcagtcttacggcgaatacctggctggtacgatcacagatgaaacccgaaaagaaatcgtacagaaaagctgtccgggcgctggtgcctgcggcggcatgtataccgccaacacgatgtcgtctgccatcgaagctctggggatgtcactcccttacagttcttccattcctgcagagcatcccgataaactcgatgagtgtatccgcgctggtgccgccatcaggaaactgctggaactggatctgaaaccccgcgacatcatgacccgcgaggctttcgaaaatgcgatggtactgattgtcgcactggggggatcgaccaacgccgtgctgcacatgctggccatcgcccgttctgtcggcctggaactgactattgatgacttccagtccgtcagcgatcgtattcctttgctggccgatttcaaacccagtggtaaatacgtgatggctgacctgcaggagattggcgggacaccagccgtgatgaaatacctgctggaaaaaggcctgatcaacggcgactgcatgacggtcacgggaaaaacagtggccgaaaacctggcagaactaccgggcctcaaagagggtcaggatatcattcacgctgtcgaaaacccgatcaagccgaccggtcacctgcagatacttaaaggcaacctggctccgacaggtgccgtcgccaagatcaccggtaaggaaggcctggtcttcgaagggaccgccaacgtcttcgattccgaagaggacatgctcaaagccctcgaagacaagcagattcaaaaaggcgatgtgatcatcatccgctacgaaggccccaaagggggaccagggatgcccgaaatgctgaccccgacttccgccatcatgggagccggcctgggtaaggatgttgccctgctgaccgacggtcgtttttctggtggttcacacggctttatcgtcggacatatcactcctgaagcacaggaaggcggtccaatcgccctggtcaaaaatggcgacaaggtcattatcgacgccgacaaaaatcgactggagatggatgtcagtgatgcagagctcgaagaacgtcgcaaagcctggacggcccctccgtttaaatacacgcggggtacactttacaaatatatcaagaatgtgaaatccgcttctgaaggttgtgtgaccgacgagtaa

SEQ ID NO: 244 - protein, 563 aa, Planctomyces maris
MSADSQPVLNKYSSRITQPRSQGASQAMLYATGMSEEDMNKAQVGISSVWYEGNSCNMHLNKLAAKVKEGVEAADLVGLRFNTIGVSDGISMGTDGMSYSLQSRDLIADSIETVTCAQWYDANISLPGCDKNMPGCLIAMGRFNRPSIMVYGGTIAPGCLNNQKLDIVSAFQSYGEYLAGTITDETRKEIVQKSCPGAGACGGMYTANTMSSAIEALGMSLPYSSSIPAEHPDKLDECIRAGAAIRKLLELDLKPRDIMTREAFENAMVLIVALGGSTNAVLHMLAIARSVGLELTIDDFQSVSDRIPLLADFKPSGKYVMADLQEIGGTPAVMKYLLEKGLINGDCMTVTGKTVAENLAELPGLKEGQDIIHAVENPIKPTGHLQILKGNLAPTGAVAKITGKEGLVFEGTANVFDSEEDMLKALEDKQIQKGDVIIIRYEGPKGGPGMPEMLTPTSAIMGAGLGKDVALLTDGRFSGGSHGFIVGHITPEAQEGGPIALVKNGDKVIIDADKNRLEMDVSDAELEERRKAWTAPPFKYTRGTLYKYIKNVKSASEGCVTDE

SEQ ID NO: 245 - DNA, 1680 bp, Algoriphagus sp.
atgaccctgaaaaaacacagttgggaaatcagcgacaattcggagcatccggctgggatggctatgttgtatgccaccggaatgagcgataaaaagatgaaacagccatttgtagggatagcgagttgcggctatgaaagtaatccctgcaatatgcatttgaacgactttgccggtctgatcaaagcttcttcacaagagcaagatctgaccggtttagtttttaataccattggtatttctgacggaaccacgatgggaaccttggggatgcgttattcactggtttctagggagataattgctgattctatagagtcttttatcatagggcattcatttgatgcttgtatttctgttgcaggatgtgacaagaatatgcctggtgcattgatggggatgatccgtactaacagaccttctattttggtgtatggaggaacgatagcctctggacattataagggagaaaagctaaatatcgtttcggcatttgaagcctttggaaagcgagtgaatggaaacatttctgatgaagattatgatggtgtcatcagaaacgcatgtccaggaaaaggagcttgtggaggtatgtatactgccaataccatgtcttcagcaattgaagcgatgggaatgtcattgccttactcctcttcttatccggcaaactctccagaaaaattgagggagtgtggagaagtgaataaatatatgagaatccttttagaaaaggatttgaaacctagtgatatcatcactagaaaaagtattgaaaatgcagtaaccgtagcaattgccttaggtggtagtaccaatgcggtaatgcatatcattgcgatcgcccgaactgccggtgtagattttaccattgaggattttaaagcaatcaatgcaaaaactccaatgattggtgatttcaaaccttctggaaaattcatgatggaagaccttcacgaacaaggtggacttcctgcctttatgaagtatatgttgcagaatgggttcattcatggagattgcttaactgtgactggaaagacggttgcagaaaaccttgagaatattgaacctgtgactccatcgatggtgaatgttattcatcctttggaaacgccgataaaagcaacgggtcatttatgtgtgctttcaggaaatcttgctccagaaggagcggttgccaaaattacaggtaaagaaggaagttcttttacaggacctgcacatgtttttgactcagagcaggatgccaatgatgctatcagagatcataaaattgagaagggtgaagttattgtcattcgaaatatcggacccaaaggtggtccaggaatgcctgaaatgttgaagcctacttctatgattataggagctggtttaggatcagacgttgccttaattactgatggaagattttccggaggaacacacggatttgtggtagggcacgttacaccagaagcgtttagcggaggacctatcggattggtcagaaatggagatatcatcacgatagatgctgataacttacagctgagcgttgcgatttctgaagaggagtttgaagaaagaaagaaaacttggaaacgaaaagaaatttctgatttgcaagggactttgaaaaaatacaataaacttgttgccactgcatctgaaggttgcgtgacagataaattctaa

SEQ ID NO: 246 - protein, 559 aa, Algoriphagus sp.
MTLKKHSWEISDNSEHPAGMAMLYATGMSDKKMKQPFVGIASCGYESNPCNMHLNDFAGLIKASSQEQDLTGLVFNTIGISDGTTMGTLGMRYSLVSREIIADSIESFIIGHSFDACISVAGCDKNMPGALMGMIRTNRPSILVYGGTIASGHYKGEKLNIVSAFEAFGKRVNGNISDEDYDGVIRNACPGKGACGGMYTANTMSSAIEAMGMSLPYSSSYPANSPEKLRECGEVNKYMRILLEKDLKPSDIITRKSIENAVTVAIALGGSTNAVMHIIAIARTAGVDFTIEDFKAINAKTPMIGDFKPSGKFMMEDLHEQGGLPAFMKYMLQNGFIHGDCLTVTGKTVAENLENIEPVTPSMVNVIHPLETPIKATGHLCVLSGNLAPEGAVAKITGKEGSSFTGPAHVFDSEQDANDAIRDHKIEKGEVIVIRNIGPKGGPGMPEMLKPTSMIIGAGLGSDVALITDGRFSGGTHGFVVGHVTPEAFSGGPIGLVRNGDIITIDADNLQLSVAISEEEFEERKKTWKRKEISDLQGTLKKYNKLVATASEGCVTDKF

SEQ ID NO: 247 - DNA, 1677 bp, Candidatus Sulcia muelleri
atggcgattaatacatttagtattaaattaactaaaaatagtactttacctgctgcacaagcaatgctgtatgctactgggttaaaagaatatgattttaatcaagctcaagttggcatagttagtaattggtatgaaggtaatccatgtaatattcatttacatattattagtaataatataaaatcatctataaaaaaaaatggaatggtggggtttaaatttaatactataggtattagtgatggtatgtctatgggaacatctggaatgagatattctttaccatcaagagaattaatagctgatagtatagaaagtgttgttaaaactcaacattatgatggattaataggaattccaggatgtgataaaaatatccctggaatagttatggcaatgttacgtattaatagaccttctatattagtatatggaggtagtatatcatcaggatattataatggtaaaaaattaaatatagtttctgcttttgaagctttaggagaaaaaaatataggtaaaatttcagaattagaatataaaaatataattaaacatgcttgtcctggtccaggagcttgtggaggaatgtatacagctaatacaatggcttcttgtcttgaagcaatgggaataacaattccatattcatcttcatcattagctaatagtagctttaaaaaaaaagaatgtattaatataggttattatataaataatatattaaaaaataatattaaaccattggatattattacttataaatctataaaaaatgctataactctagcaatagcattaggaggatcaacaaatttagtaatacatattttagcaatagctaaaactgctaatttagatctaaaattagatgatattcaaaatatcaataataatgttccaattatagctaatttaaaaccaagtggagattttttaatggaagatatacaatctatgggaggaattcctataattataaaatatttattaaaagaaggatatatagaaggagactgtattactgtaacaggaaacacaataaaaaaaaatttagaaaatatacctgatctttcttttaaagaaaaaattatatatcctttattaaatcctataaaaaaaaatgggcatatacgtattttatatggtaatatagccccttatggagctgttgctaaaattactggaaaagaaggtgatattttttcaggatttgcacaagtttttaattcagaaaactctgctaataaagcaataattaataataaaattaaagaaggagatgtaatagtaattagatatgtaggtcccagaggaggtcctggaatgcctgaaatgcttaaacctacttcttacataatgggggctaatttaagtaaaaaaattgctttaataactgatgggagattttcaggaggatctcatggatttgtagtaggtcatattactccagaggctcaaaatggaggattaattgctttaatagaaaatggagatattataataattgatgcaataaagaatactataacattaaaaatatcaaaaaaagaaataaaaaatagaaaaaaaacacccttgcgagtgcgaggtaaagtaaattcaggttatttatataagtatacaaaaactgtatcatctgcttataatggatgtgtaacagataaattgtaa

SEQ ID NO: 248 - protein, 558 aa, Candidatus Sulcia muelleri
MAINTFSIKLTKNSTLPAAQAMLYATGLKEYDFNQAQVGIVSNWYEGNPCNIHLHIISNNIKSSIKKNGMVGFKFNTIGISDGMSMGTSGMRYSLPSRELIADSIESVVKTQHYDGLIGIPGCDKNIPGIVMAMLRINRPSILVYGGSISSGYYNGKKLNIVSAFEALGEKNIGKISELEYKNIIKHACPGPGACGGMYTANTMASCLEAMGITIPYSSSSLANSSFKKKECINIGYYINNILKNNIKPLDIITYKSIKNAITLAIALGGSTNLVIHILAIAKTANLDLKLDDIQNINNNVPIIANLKPSGDFLMEDIQSMGGIPIIIKYLLKEGYIEGDCITVTGNTIKKNLENIPDLSFKEKIIYPLLNPIKKNGHIRILYGNIAPYGAVAKITGKEGDIFSGFAQVFNSENSANKAIINNKIKEGDVIVIRYVGPRGGPGMPEMLKPTSYIMGANLSKKIALITDGRFSGGSHGFVVGHITPEAQNGGLIALIENGDIIIIDAIKNTITLKISKKEIKNRKKTPLRVRGKVNSGYLYKYTKTVSSAYNGCVTDKL

SEQ ID NO: 249 - DNA, 1650 bp, Candidatus Carsonella
atgaaatcaaaattaataacaaaatggccaataaaagcagcaaatagagccatgttgcgtgcagttggatataacgattatgattttaataaatttcaagttggaattgcatcaacttggagtaatataacaccttgtaataatcatatcaatgtattagctaaagcagttgaatatggagtaaattcaaaattttgtaaaggaacaatatttaatacaataacagtatctgatggaatatcaaatggtaattttggaatgaaatattcattactatcaagagatataatttcaaattcaatagaagttgttggcaaagcacaaaattttgatggtattatttctattggaggatgtgacaaaaatattcctggttgtattattggaatgtgtaatttagaaattccttcaatttttatatatggtggtacaattttaccaggcaaaaatagaacagatattgtctctgtttttgaatctttgggtaaattttataataaaactattaatgaaaaagaattgttaaatattgaaaaaaactccattattggatctggatcatgtagtggaatgtatacagcaaattcaatggcaattgttgcagaatgcctaggaattagcttaccaaactcttctattcaaaatgcgcaatcaattaataaaattgttaattgtattaattctggtaaattaataaaaatattgttagaaaataatattacaataaaaaaaattattaataaagaatctattttaaattctataaaagtaatttcattattaggtggatcaacaaattgtttaattcatttattagcaattgctaattgtttaaaaataaatttatctttaaaagatttacaatttgaaactaataacttaccaacgttatctgatttaaaaccaagtggaaaattttttatttcagatttaattaatactggtggaatacaaaaatttttaaaatatttaattgatattaatttaataaatggtaatttattaacggttacaggtaattcattaaaagaaaatttaaaatttattaaaataaattataaaaataaaatactaaaagatatcaataatcctgttaaaaaaactaatcaaatcaaaatattatttggaaacttatcaataaatggttgtatatcaaaaatatcgggtaaagaaggagaaatattctttggaaaagcactagtatttaattcagaagaagaatctgttaattatatttataaaaaaaaaattcaaaataacacaattataattataaggtatgaaggtccaaaaggaggccctggaatgagagaaatgttaactcctacttctgctttaataggagttggaaagaaaaattctgttgctttaataacagatggtagattttcaggtggaagccacggatttgttgtaggacatatttcgccagaagcatatgattttggtacaatttgtttaattaataataatgatctaataataatagatactataaacaattttattagtttatttttaaacaaaagaagcttaaaaagtagattttataaagttaaaatatttaacaaaatagtttcaggtattttaaatttatataaaaaatattcgatttgctcatcgaaaggtgcattattaaattatgaataa

SEQ ID NO: 250 - protein, 549 aa, Candidatus Carsonella
MKSKLITKWPIKAANRAMLRAVGYNDYDFNKFQVGIASTWSNITPCNNHINVLAKAVEYGVNSKFCKGTIFNTITVSDGISNGNFGMKYSLLSRDIISNSIEVVGKAQNFDGIISIGGCDKNIPGCIIGMCNLEIPSIFIYGGTILPGKNRTDIVSVFESLGKFYNKTINEKELLNIEKNSIIGSGSCSGMYTANSMAIVAECLGISLPNSSIQNAQSINKIVNCINSGKLIKILLENNITIKKIINKESILNSIKVISLLGGSTNCLIHLLAIANCLKINLSLKDLQFETNNLPTLSDLKPSGKFFISDLINTGGIQKFLKYLIDINLINGNLLTVTGNSLKENLKFIKINYKNKILKDINNPVKKTNQIKILFGNLSINGCISKISGKEGEIFFGKALVFNSEEESVNYIYKKKIQNNTIIIIRYEGPKGGPGMREMLTPTSALIGVGKKNSVALITDGRFSGGSHGFVVGHISPEAYDFGTICLINNNDLIIIDTINNFISLFLNKRSLKSRFYKVKIFNKIVSGILNLYKKYSICSSKGALLNYE

SEQ ID NO: 251 - DNA, 1674 bp, Synechococcus sp.
atgctccgctccgacgccgtcacgcagggaatctcccgctcccccaaccgcgccatgttgcgtgcggtcggttttggtgacgccgacttcggcaagccgatcatcggcatcgccaacggctacagcaccatcaccccctgcaatgtggggctgaacgatctggcgatgcgagctgaagcgtcagcgcgtcaggccggcggcatgccccaaaccttcggaaccatcaccgtcagcgatggcatttcgatgggcacggaaggaatgaagtactccctggtgagcagggaagtgatcgctgacgcgatcgaaacggcctgcaatggccagagcatggatggggtgctcgctgtcggtggctgcgacaaaaacatgcccggcgccatgctcgcgatggcccgcatgaacatcccgtccatttttgtctatggcggcaccatcaaacccggcaaactcggcggctgtgatctcaccgtggtgagtgcctttgaggccgtaggtcagatcaccagcggcaagattgacgaagaacagctaacggcgattgaaaagaatgcctgccccggtgcaggcagctgtggcggcatgttcaccgccaacaccatgagtgctgcgatcgaaaccctcggtctgagcctgccctacagctccaccatggcggcggaagactccgagaaggctgatagcgcagcccgttcagccgaggtgcttgttgatgccatcaaagccaacattcgcccgcttgatctactcaccaaggaagcgtttgaaaacgccatcagcgtgattatggccgtgggtggctccaccaattcagtgctccacctgctcgccattgcccgcactgccggcgtcgatctgagcatcgacgattttgagcgcatccgtcagcgggtcccggtgatctgtgacctcaaacccagtggccgttttgtcacggttgatcttcatcaggctgggggcattcctcaggtgatgaaattgcttctggatggaggactactccatggcgagtgccgcaccatcgaaggcaaaagcctgaaggaactgttggctgatgtgccttcggttccgcctgctgatcaggaggtcattcgcccactgtccaatcccttgtacgccaaggggcacctggccatcctcaaaggcaacctcgcctcagaaggtgccgtcgcaaagatcagcggtgtgaaaaatccggtgatcaccggtccggcacgggtgttcgaaagcgaagaaacctgccttgccgccatcctcgacaaccaggtcaaggccggtgatgtggtggtcgttcgcaacgaaggcccggtgggtggtcccggcatgcgggaaatgctcagccccacatccgcaattgtgggacagggcctgctcgacaaagtggccctgattaccgacggacgtttctccggtggttcctacggcttggtgatcggccacgtggcgccagaagccgccgtcggtggcaccatcggcctagtgcatgaaggcgacagcatcactgtcgacgccaacaaactgctgattcaactgaacatcgacgaagccgaactggaacgccgccgtaacgcctgggcgcctgcgaccccgaagtaccgcacagggatcctgggcaaatatgcgcgcctggtctcaagttccagccgcggcgccaccaccgacatcgcggactaa

SEQ ID NO: 252 - protein, 557 aa, Synechococcus sp.
MLRSDAVTQGISRSPNRAMLRAVGFGDADFGKPIIGIANGYSTITPCNVGLNDLAMRAEASARQAGGMPQTFGTITVSDGISMGTEGMKYSLVSREVIADAIETACNGQSMDGVLAVGGCDKNMPGAMLAMARMNIPSIFVYGGTIKPGKLGGCDLTVVSAFEAVGQITSGKIDEEQLTAIEKNACPGAGSCGGMFTANTMSAAIETLGLSLPYSSTMAAEDSEKADSAARSAEVLVDAIKANIRPLDLLTKEAFENAISVIMAVGGSTNSVLHLLAIARTAGVDLSIDDFERIRQRVPVICDLKPSGRFVTVDLHQAGGIPQVMKLLLDGGLLHGECRTIEGKSLKELLADVPSVPPADQEVIRPLSNPLYAKGHLAILKGNLASEGAVAKISGVKNPVITGPARVFESEETCLAAILDNQVKAGDVVVVRNEGPVGGPGMREMLSPTSAIVGQGLLDKVALITDGRFSGGSYGLVIGHVAPEAAVGGTIGLVHEGDSITVDANKLLIQLNIDEAELERRRNAWAPATPKYRTGILGKYARLVSSSSRGATTDIAD

SEQ ID NO: 253 - DNA, 1671 bp, Synechococcus sp.
atgctccgctccgatgccgttaccaaggggattcagcgctcacccaatcgggcgatgctgcgagccgtcggtttcggcgatcaggacttcggaaaaccaatcattggcatcgccaacggctacagcacgatcacgccctgcaacgttgggctcgatgatctcgccaggcgtgccgaagaggcggcccgcctagcgggaggtatgcctcaaacgttcgggaccatcaccgtcagcgacgggatctcgatgggaacagagggaatgaaatattccctggtgagccgggaagtgatcgccgacgccatcgaaacagcctgcaatggccagagcatggacggcgtgttggccgtgggcggctgcgacaagaacatgcctggagccatgctcgcgatggcgaggatgaacatcccggcgatcttcgtgtacggcggcaccatcaagcccggaaaactcggcggctgcgacctcaccgtggtcagtgcttttgaagcggtcggtcagatcaccagcggcaagatcgacgaggagcagctcacggccatcgagaaaaatgcctgccccggggctggcagctgcggcggcatgttcaccgccaacaccatgagcgccgccatcgaaacgatgggactcagccttccgcacagctccaccatggctgctgaagatgaagagaaggccgagagcgcagcccgatcggcggaggtgttggtgcaggccatcgaatccggcatccgccccctcgacctgatgacccgtgaggccttcgaaaatgccatcagcgtgatcatggcggtgggtggttccaccaattccgtgctgcatttgctcgccattgcccgcactgctggggtggagctcgccatcgacgactttgaacggatccgccagcgcgttccagtgatctgcgacctcaaacccagtggccgttacgtcacggtggacctccaccgcgccggtggaattccccaggtgatgaaactgctgctggatgccggactcctccacggtgattgccgcaccatcgaaggcaaaaccctgaaggagctgcttgccgatgtgccctccactccgcccgcggatcaggatgtgattcggccgctctccaatcccctttatgccaagggccacctggccatccttaagggcaatctggcttccgaaggagctgtcgcgaagatcagtggtgtgaagaatccggtgatcaccggtccagcaagggtgtttgagagcgaagaaagctgtcttgaagcgattctcgacaatcagatcaaggccggtgatgtggtggtggtgcgcaatgaaggcccggtcggcggaccgggcatgcgcgagatgctcagtcccacgtccgcgatcgtgggacaagggctactcgacaaggtggcgctgatcaccgacggacgcttttcaggtggctcctatggcctcgtgattggccatgtagcccccgaagcggccgtgggcggaaccatcggtttgatcgaggaaggagacagcatcaccgtggacgccaatcagctgctgctgcaactgaatgtggaggaggctgagctggagcggaggcggagtgcatggtcggcaccagtgccgaagtaccgcacggggatcctcggcaaatatgcccggcttgtgagttccagcagccagggtgcggtcaccgaccagccctga

SEQ ID NO: 254 - protein, 556 aa, Synechococcus sp.
MLRSDAVTKGIQRSPNRAMLRAVGFGDQDFGKPIIGIANGYSTITPCNVGLDDLARRAEEAARLAGGMPQTFGTITVSDGISMGTEGMKYSLVSREVIADAIETACNGQSMDGVLAVGGCDKNMPGAMLAMARMNIPAIFVYGGTIKPGKLGGCDLTVVSAFEAVGQITSGKIDEEQLTAIEKNACPGAGSCGGMFTANTMSAAIETMGLSLPHSSTMAAEDEEKAESAARSAEVLVQAIESGIRPLDLMTREAFENAISVIMAVGGSTNSVLHLLAIARTAGVELAIDDFERIRQRVPVICDLKPSGRYVTVDLHRAGGIPQVMKLLLDAGLLHGDCRTIEGKTLKELLADVPSTPPADQDVIRPLSNPLYAKGHLAILKGNLASEGAVAKISGVKNPVITGPARVFESEESCLEAILDNQIKAGDVVVVRNEGPVGGPGMREMLSPTSAIVGQGLLDKVALITDGRFSGGSYGLVIGHVAPEAAVGGTIGLIEEGDSITVDANQLLLQLNVEEAELERRRSAWSAPVPKYRTGILGKYARLVSSSSQGAVTDQP

SEQ ID NO: 255 - DNA, 1674 bp, Synechococcus sp.
atgcttcgctcagacgccgtcactcaaggcattcagcgctcacccaatcgagcaatgctgagagcggttggcttcggtgatgaagatttcggcaagcccattatcgggatcgctaacggttacagcacgattacaccttgcaatgtgggattgaatggtctgtcccgtcgtgccgaagattcggctcgaaaggcaggtggaatgcctcagactttcggaaccatcaccgtcagcgatggcatctcgatgggcacggaaggaatgaaatattccttggtgagccgtgaagtgattgctgatgcaattgaaacggcctgcaatgggcaaagtatggatggcgttctggcggttggtggttgcgataaaaatatgcctggcgccatgttggcgatggcacgtatgaatatcccctcgatttttgtgtacgggggaacaattaagccgggaaaattaggtggctgtgacctcactgttgtgagtgcttttgaggctgtcggtcagattacgagtgggaaaattgatgaagagcagctaactgcgattgaaaaaaatgcctgcccaggtgctggcagctgtggaggcatgttcacggccaatacgatgagtgctgcgattgaaacgatggggctgagtcttccccacagttcaacgatggctgccgaagatgaggaaaaagcagagagtgcggctcgttctggtgaagtcctcgttgaggcaattaaatccaatattcgcccccttgatttgctcacgcgggaagcctttgaaaatgccatcagcgtgatcatggcggtgggcggctccaccaactctgtgttgcatttgcttgctatcgcgcgcacagcaggcgtggatctcagcatcgacgactttgaacagatccgccaacgcgttccggtgatttgtgatctaaaaccgagtggtcgttttgtcaccgtggatcttcatcaggctgggggcattccacaggtgatgaaattgcttttagatgcgggcttgctccatggcgattgccgcacgattgaagggaaaacattgaaagaattgttggctgatattccttcaacgcctcctgaaggacaagaagtgattaggccgttaagtaaccccctttatgccaaagggcatttggccattctgaaaggaaatttggcaagcgaaggagctgtcgccaaaatcagcggcatcaaaacgcctgtcctcacaggtcctgctcgcgtttttgaaagcgaagaggattgtttagcgtcgattattggtaaacatattcatgctggtgatgtcatcgtgattcgccaggaaggtccagtgggaggtcctggaatgcgcgaaatgcttgcaccaactgctgccattgttgggcagggactcggtgacaaggtggcgctgattacggatggtcgattcagtggtggaacctatggtttggtggttggccacgtggctccagaagctgccgttggtggagcaatcggccttgttatggaaggagacagcatcactgtggatgccaatcaaaaccttcttcaactcaatgtgaatgaggctgaactcgaaacacgccgccgcacttggtcaggacataagcctagatacaagactggaattcttggcaaatatgctcgacttgtctcgagttctagtcgtggtgccgtgacagatcagcctgattaa

SEQ ID NO: 256 - protein, 557 aa, Synechococcus sp.
MLRSDAVTQGIQRSPNRAMLRAVGFGDEDFGKPIIGIANGYSTITPCNVGLNGLSRRAEDSARKAGGMPQTFGTITVSDGISMGTEGMKYSLVSREVIADAIETACNGQSMDGVLAVGGCDKNMPGAMLAMARMNIPSIFVYGGTIKPGKLGGCDLTVVSAFEAVGQITSGKIDEEQLTAIEKNACPGAGSCGGMFTANTMSAAIETMGLSLPHSSTMAAEDEEKAESAARSGEVLVEAIKSNIRPLDLLTREAFENAISVIMAVGGSTNSVLHLLAIARTAGVDLSIDDFEQIRQRVPVICDLKPSGRFVTVDLHQAGGIPQVMKLLLDAGLLHGDCRTIEGKTLKELLADIPSTPPEGQEVIRPLSNPLYAKGHLAILKGNLASEGAVAKISGIKTPVLTGPARVFESEEDCLASIIGKHIHAGDVIVIRQEGPVGGPGMREMLAPTAAIVGQGLGDKVALITDGRFSGGTYGLVVGHVAPEAAVGGAIGLVMEGDSITVDANQNLLQLNVNEAELETRRRTWSGHKPRYKTGILGKYARLVSSSSRGAVTDQPD

SEQ ID NO: 257 - DNA, 1674 bp, Synechococcus sp.
atgcttcgctccgacgccgtcaccaaggggatccagcggtctcccaaccgcgccatgttgcgggccgtgggctttggagacagtgatttcggcaagcccatcctgggcattgccaacggctacagcactatcaccccctgcaatatcgggctgaacgacctggccaaacgggctgaggaagcagcccgccaggccggaggcatgccccagatgtttggaaccatcaccgtgagtgatggaatctccatgggcactgaagggatgaagtactccctggtgagccgtgaagtgattgctgacgccatcgaaacggcctgcaacggtcagagcatggatggggtgctggccgttggtggctgcgacaagaacatgcctggcgccatgctggccatggctcggatgaacattccttcggttttcgtctacggcggcacgatcaagccgggcaagctcgggggctgtgatctcacggtggtgagcgcttttgaggcggtggggcaactcaccagcggcaagatcgacgaagtgcagctcaccgcagttgagaaaaatgcctgccctggggctggcagttgcggcggcatgttcaccgccaacaccatgagtgccgccatcgaaacgatggggctgagccttccctacagctccacgatggcagccgaggacgaggaaaaggccgacagtgccgctcgctccgctgaggtgctggtggaggcagtgaaagccaacattcgccctctggacctgctcaccaaggaagcctttgagaacgccattagcgtgatcatggcggtgggtggctccaccaatgcggtactgcacctgctggccattgcccgtaccgccggcgtcgacctgagcatcgatgacttcgaacggatccgtcagcgggtgccggtgatctgtgatctcaagcccagcggccgctacgtgaccgttgatctgcacaacgccggcggcattccccaggtgatgaagctgctgctggatgctggcttgctgcacagcgactgccgaaccgtggaaggcaaaagcctgaaggagttgctggccgatgtgccgtcggagccccccgccgggcaggaggtgatccgccccctcagcaatccgctgtacgccaaaggtcacctcgccatccttaagggcaacctcgccagcgagggaagcgtggccaagatcagcggcgtgaaaacccctgtgctcactggccctgcgcgggtgtttgaaagcgaggaagactgccttgccgccatcctcgataaaaagatccaggccggggatgtggtggtggtccgcaacgagggtcccgttggtggaccgggcatgcgggaaatgctggctccaacttcagcgattgttggtcagggcctgggggacaaggtcgccctgatcaccgatggccgctttagcggcggcacctatggcctggtggtgggtcatgtggctcctgaagctgctgttggtggaacgatcggcctggtgcaagaaggcgacagcatcacggttgatgctgatcagctgctgctccaactcaacgtggatcaagcggaactggatcgccgtcgtgcgggatggagcaagccggaaccgcgttaccgcagcggaattctcggcaagtacgcgcggctcgtctccagctcaagccggggtgcaaccaccgaccacgccgactga

SEQ ID NO: 258 - protein, 557 aa, Synechococcus sp.
MLRSDAVTKGIQRSPNRAMLRAVGFGDSDFGKPILGIANGYSTITPCNIGLNDLAKRAEEAARQAGGMPQMFGTITVSDGISMGTEGMKYSLVSREVIADAIETACNGQSMDGVLAVGGCDKNMPGAMLAMARMNIPSVFVYGGTIKPGKLGGCDLTVVSAFEAVGQLTSGKIDEVQLTAVEKNACPGAGSCGGMFTANTMSAAIETMGLSLPYSSTMAAEDEEKADSAARSAEVLVEAVKANIRPLDLLTKEAFENAISVIMAVGGSTNAVLHLLAIARTAGVDLSIDDFERIRQRVPVICDLKPSGRYVTVDLHNAGGIPQVMKLLLDAGLLHSDCRTVEGKSLKELLADVPSEPPAGQEVIRPLSNPLYAKGHLAILKGNLASEGSVAKISGVKTPVLTGPARVFESEEDCLAAILDKKIQAGDVVVVRNEGPVGGPGMREMLAPTSAIVGQGLGDKVALITDGRFSGGTYGLVVGHVAPEAAVGGTIGLVQEGDSITVDADQLLLQLNVDQAELDRRRAGWSKPEPRYRSGILGKYARLVSSSSRGATTDHAD

SEQ ID NO: 259 - DNA, 1674 bp, Synechococcus sp.
atgcttcgttccgacgccgtcacaaaggggatccagcgttcccccaaccgcgccatgctccgtgcggtgggattcggagatgaggacttcggcaagccgattctcgggatcgccaacggctacagcacgatcacaccctgcaatgtcgggttgaacgacctgtcccggcgcgctgaagaggctgcccgtcaggccggcggcatgccacagatgttcggaaccatcacggtgagtgatggcatctccatgggcaccgaagggatgaagtactccctggtaagccgtgaggtgatcgccgatgcgattgaaaccgcctgcaatggccagagcatggatggcgtgctggcggtgggcggctgcgacaagaacatgcccggcgccatgttggccatggcgcggatgaacattccggctgtgttcgtttacggcggcacgatcaagccggggaaactcggcggctgtgatctcaccgtggtcagcgcctttgaggcagttggtcagctcaccagcggcaacatcgacgaagaccagctcaccgctgtcgaaaagaacgcttgcccaggagccggcagctgcggcggcatgttcaccgccaacacgatgagtgcagccatcgaaacgatggggttgagcctgccctacagctcaacgatggcggcagaagacgaagagaaggccgacaatgccgctcgttcagcagaggtgttgttggacgcggtgaaggccaacattcgacccttggatctgctcaccaacgatgcattcgagaacgccatcagcgtgatcatggcggtgggtggatccaccaacgccgtgctgcacctgctggcgatcgcccgtacggctggggtctccctcagcatcgacgacttcgagcggatccgtcagcgcgtgccggtgatctgtgacctcaagccgagcggccgctacgtgacggtggatctccacaacgctggcggtatcccccaggtgatgagactgctgctcgatgccgggctgctgcatggcgattgccgcaccgttgagggcaaaagcctgcgtgaggtgctggcggatgtgccctccgtgccaccggccgatcaagacgtgatccgtccactgagcaatcccctttacggcaaaggccacctggccatcctcaagggcaacctggccagtgagggcagtgtggccaagatcagcggcgtcaagacaccagtgctcaccggccccgcccgggtatttgagagcgaggaagactgcctcgccgccatcctggatcaacggatcaaggccggcgatgtggtggtggtgcgcaatgaggggcccgtgggaggtccgggcatgcgcgaaatgctggcccctacctccgccatcgtcgggcaaggcctgggagacagggtggctctgatcaccgatggccgcttcagcggcggcacctatggcctggtggtcggtcacgttgcccccgaagccgctgtcggcggaaccatcggcctggtgcagggaggcgacagcatcaccgtggatgccgaccagttgctgctgcaactcaacgtggatgaggcggaactcacgcgacgccgggcagcctggagcaagccggaaccccgttatcgcactgggattctgggcaagtacgcccgtctggtgtccagttcaagccgtggagcggtcaccgaccagcccgactga

SEQ ID NO: 260 - protein, 557 aa, Synechococcus sp.
MLRSDAVTKGIQRSPNRAMLRAVGFGDEDFGKPILGIANGYSTITPCNVGLNDLSRRAEEAARQAGGMPQMFGTITVSDGISMGTEGMKYSLVSREVIADAIETACNGQSMDGVLAVGGCDKNMPGAMLAMARMNIPAVFVYGGTIKPGKLGGCDLTVVSAFEAVGQLTSGNIDEDQLTAVEKNACPGAGSCGGMFTANTMSAAIETMGLSLPYSSTMAAEDEEKADNAARSAEVLLDAVKANIRPLDLLTNDAFENAISVIMAVGGSTNAVLHLLAIARTAGVSLSIDDFERIRQRVPVICDLKPSGRYVTVDLHNAGGIPQVMRLLLDAGLLHGDCRTVEGKSLREVLADVPSVPPADQDVIRPLSNPLYGKGHLAILKGNLASEGSVAKISGVKTPVLTGPARVFESEEDCLAAILDQRIKAGDVVVVRNEGPVGGPGMREMLAPTSAIVGQGLGDRVALITDGRFSGGTYGLVVGHVAPEAAVGGTIGLVQGGDSITVDADQLLLQLNVDEAELTRRRAAWSKPEPRYRTGILGKYARLVSSSSRGAVTDQPD

SEQ ID NO: 261 - DNA, 1674 bp, Synechococcus sp.
atgctcagatccgacgccgttaccaaagggattcagcgatcccccaaccgcgccatgctccgggccgttggttttggtgatgctgatttcggcaaaccgatcctgggaatcgccaacggctacagcacgattacgccctgcaatatcgggcttgatgttttagcgaaacgtgccgaagaagcggcccgtctggctggaggaatgccgcaaatgtttggcaccatcacggtgagtgatggaatctcgatggggactgaagggatgaaatattcccttgtcagccgagaagtcatcgccgatgccatcgaaacggcctgtaacggtcagagcatggatggagtcttggcagttggtggctgcgacaaaaatatgcctggtgcgatgttggccatggcacggatgaatatcccctccgtgtttgtttatgggggaacgatcaagccgggaaaactcggcggctgtgatctcactgtggtgagtgcctttgaagccgttggtcaaatcaccagcggcaaaatcgatgaagaacaactcacggcggtggaaaagaacgcctgtcctggtgcaggaagttgcggcggcatgtttaccgccaacacgatgagtgcagccatcgaaacgatggggttaagccttccttacagctccacgatggcggccgaagaccaggaaaaagcggacagcgcggctcgctcagcagaggtgttggtggatgccgtgaaagccaacatccggccgctcgatctgctcacaaaacaagccttcgaaaacgccatcagcgtgatcatggcggtcggcggttccaccaatgccgttttgcatttgctggcgattgctcgcacagctggggttgatttgagcattgacgactttgaacgcattcggcaacgcgtcccagtgatctgcgatctcaaacccagcggtcggtttgtcaccgttgatctgcacaacgctggaggaatccctcaagtgatgaagttgctgcttgatgccggattgctccacggcgattgccaaacagttgaagggaaaagtctcaacgcattgttggcggatgtgccatctgcaccccccgcagaccaagaggtgattcgacctctgagcaatccgatgtacagcaaaggacaccttgccatcctcaaaggaaatttggccctggagggcagtgtggccaagatcagcggcgtcaaaactcctgtactgacgggtccagctcgggtttttgaaagtgaggaagactgtctggcctccatccttgagaaaaggatcaatgcgggagacgtcgttgtgatccgctacgaaggtccggtcggtggacctggcatgcgggaaatgttggcgcccacctcagccatcgtcggccagggactcggcgacaaagtggcattaattaccgatggacgatttagcggtggtacctacggactcgtggtgggtcacgtcgctccagaagccgctgttggtggaacgattggccttgtgcaagagggagacagcatcaccgtggatgccaatcaactcttgcttcagctcaatgttgacgacacggaattagccaaacgacgagcagcatggtcgaaaccaaaacctcaatacaccactggaattttgggtaaatatgcccgactcgtttccacatccagcaaaggggctgtcaccgatcaaccggattaa

SEQ ID NO: 262 - protein, 557 aa, Synechococcus sp.
MLRSDAVTKGIQRSPNRAMLRAVGFGDADFGKPILGIANGYSTITPCNIGLDVLAKRAEEAARLAGGMPQMFGTITVSDGISMGTEGMKYSLVSREVIADAIETACNGQSMDGVLAVGGCDKNMPGAMLAMARMNIPSVFVYGGTIKPGKLGGCDLTVVSAFEAVGQITSGKIDEEQLTAVEKNACPGAGSCGGMFTANTMSAAIETMGLSLPYSSTMAAEDQEKADSAARSAEVLVDAVKANIRPLDLLTKQAFENAISVIMAVGGSTNAVLHLLAIARTAGVDLSIDDFERIRQRVPVICDLKPSGRFVTVDLHNAGGIPQVMKLLLDAGLLHGDCQTVEGKSLNALLADVPSAPPADQEVIRPLSNPMYSKGHLAILKGNLALEGSVAKISGVKTPVLTGPARVFESEEDCLASILEKRINAGDVVVIRYEGPVGGPGMREMLAPTSAIVGQGLGDKVALITDGRFSGGTYGLVVGHVAPEAAVGGTIGLVQEGDSITVDANQLLLQLNVDDTELAKRRAAWSKPKPQYTTGILGKYARLVSTSSKGAVTDQPD

SEQ ID NO: 263 - DNA, 1677 bp, Synechococcus sp.
atggcccccctccgatccagcgccatcacgcaaggtgttcagcgcagtcccaaccgcgccatgttgcgcgctgttggtttcggagatggtgacttcagcaaaccgatcatcgggattgccaacggttacagcaccatcacgccctgcaatgtggggctcaacgatctagccctgcgcgccgaagcagccacacaagcagccggggggatgccgcaactcttcggcaccatcaccgtgagtgatggcatctccatgggcaccgaggggatgaagtactccctggtgagccgcgaagtgattgccgatgccatcgagaccgcctgcaacggtcaaagcatggatggcgtattggccatcggcggctgcgacaaaaacatgcccgccgccatgttggcgatggcgcggatgaacatcccaggtgtcttcgtctatggcggcaccatcaagcccggcaaattgggcggctgcgacctcaccgtggtcagcgcctttgaagcggttggtcagttgagcagcggcaagatcgatgaagcccagctcaccgctgttgaaaagaacgcttgcccaggagctggcagctgtggtggcatgttcacggccaacacgatgagtgcggccatcgaaacgatggggttgagcttgccgttcagctccaccatggcggcggaagatcccgagaaagccgagagcgctgctcgctcggctgaggtgttggtggaggccattgctgccaacattcgtccgttggatctgctgacccgcgaagcgtttgaaaacgccatcagcgtgatcatggccgtgggtggctccaccaatgcggtgttgcacttgctcgcgattgcacgcaccgccggcgtaccactgtcaatcgacgacttcgaaacgattcggcaacgggtgcctgtgatctgcgatctcaaaccaagcggacgctttgtaacggtcgacctgcacaacgctggtggcattccgcaagtcatgaaacttctgctcgatggtgggttgctccatggcgattgccgcaccgtggagggcaaaaccttgcgagaggttctggctgatgttccctcagaaccgccggctgatcaggaggtgatccggcccctgagcaatcccctctatgccaaagggcacctggctgtgttgaaaggcaacctcgccagtgaaggggctgtcgccaagatcagtggtgtcaaaacaccagtgctcacaggcccagccagggtgtttgaaagcgaagagcagtgcctgcaggcgatcttggcgaaccaggttcacgcaggtgatgtggtggtggtgcgcaatgaaggccccgttggtggcccgggaatgcgggagatgttggcgcccaccgccgccatcgttggtgaagggctcggcgacaaggtggcgttgatcaccgacggtcgcttcagcggcggcacctacggcctggtggttgggcatgtggccccagaagcagccgtaggcggcatgatcggcctggtgcaagagggcgattccatcaccgtggatgcccaacaacaattgctgcagctcaatgtggatgccgctgaattggagcggcgcaagcaagcgtgggtcaaaccagaaccgcgttaccgcaccggtgttttgggtaaatacgcccgtttggtgagcagcagcagcaagggcgctgtgactgatcaaccctga

SEQ ID NO: 264 - protein, 558 aa, Synechococcus sp.
MAPLRSSAITQGVQRSPNRAMLRAVGFGDGDFSKPIIGIANGYSTITPCNVGLNDLALRAEAATQAAGGMPQLFGTITVSDGISMGTEGMKYSLVSREVIADAIETACNGQSMDGVLAIGGCDKNMPAAMLAMARMNIPGVFVYGGTIKPGKLGGCDLTVVSAFEAVGQLSSGKIDEAQLTAVEKNACPGAGSCGGMFTANTMSAAIETMGLSLPFSSTMAAEDPEKAESAARSAEVLVEAIAANIRPLDLLTREAFENAISVIMAVGGSTNAVLHLLAIARTAGVPLSIDDFETIRQRVPVICDLKPSGRFVTVDLHNAGGIPQVMKLLLDGGLLHGDCRTVEGKTLREVLADVPSEPPADQEVIRPLSNPLYAKGHLAVLKGNLASEGAVAKISGVKTPVLTGPARVFESEEQCLQAILANQVHAGDVVVVRNEGPVGGPGMREMLAPTAAIVGEGLGDKVALITDGRFSGGTYGLVVGHVAPEAAVGGMIGLVQEGDSITVDAQQQLLQLNVDAAELERRKQAWVKPEPRYRTGVLGKYARLVSSSSKGAVTDQP

SEQ ID NO: 265 - DNA, 1671 bp, Synechococcus sp.
atgctccgctccgccgcgatcacccaggggattcagcgctctccgaatcgagccatgctccgtgctgtgggtttcggcgacggcgacttcaacaagccgatcatcggcatcgccaacggctacagcaccatcaccccctgcaatctggggctcaatgatcttgctcgacgcgccgaggaagccgcccatcaggtgggagcgatgccccagatgttcggcaccatcaccgtgagcgatgggatttcgatggggaccgaagggatgaaatattcccttgtgagccgggaggtgattgccgattcgatcgaaacggtcgtcaacgggcaaagcatggatgccctgctggcgatcggtggctgtgacaagaacatgcctggtgccatgctggcgatggcgaggatgaacgtcccctcgatcttcgtgtatggcggcaccatcaagcctggcaagctcggtgcctgtgacctcaccgtggtgagtgcctttgaggcggtgggccagttcagtggcggcaagatcgaggagcaggaactcacggcgatcgagaaaaacgcctgccctggggcgggcagctgcgggggcatgtttactgccaacaccatgagtgccgccttcgaggtgctggggctgagcttgccctacagctccacgatggcggccgaagaccccgagaaggccgatagcgccgcccgtagtgccgaggttttggccgacgccatcgaggcccagatcctcccgcgcgatctgatgacgcgcgaagccttcgaaaacgccatcagtgtgatcatggccgtgggtggctccaccaactccgtgctgcatctgctggctgtcgcccgcacggcgggggtggcgctgagcattgacgacttcgagcggatccggcagcgcgtgccggtgatctgtgatctcaagccaagtggccgcttcgtgacggtggatctgcaccgggctgggggcattccccaggtgatgaaactactgctcgatgcagggctcttgcacggcgactgccgcacgatcgaaggcaagacccttcacgaggtgctcgccgctgtgccgtcggtcccccccgccggccaggaggtgattcggcccctgagccatccgctgtatgccaaggggcacctggcgatcctcaaaggcaacctggccgaggaaggcgcggtggccaagatcagcggcgtcaaaaacccggtcatcaccggccctgcccgcgtgttcgagagcgaagaaacctgcctggccgccattctcgacaagcagatcaaccccggcgatgtggtggtcgtgcgcaatgaggggccggtgggcggtcctggcatgcgggagatgctcagccccacctccgcgatcgtgggccaggggctgctcgacaaggtggctctgatcaccgatggccgcttctcaggcggttcctacggcctggtgatcggccacgtggctccggaggccgccgtggggggcacaatcggcctggtgcaggaaggcgacagcatcaccgtggatgcgaatcagctgctgattcaactcaacgtggatgaatccgagctagctcaacgtcgcgccgcctggacccaacccgaaccccggtatcgcaccggcatcctcggcaaatacgcccgacaggtgagctccagcagtgtgggggcggtgaccgatcagccctga

SEQ ID NO: 266 - protein, 556 aa, Synechococcus sp.
MLRSAAITQGIQRSPNRAMLRAVGFGDGDFNKPIIGIANGYSTITPCNLGLNDLARRAEEAAHQVGAMPQMFGTITVSDGISMGTEGMKYSLVSREVIADSIETVVNGQSMDALLAIGGCDKNMPGAMLAMARMNVPSIFVYGGTIKPGKLGACDLTVVSAFEAVGQFSGGKIEEQELTAIEKNACPGAGSCGGMFTANTMSAAFEVLGLSLPYSSTMAAEDPEKADSAARSAEVLADAIEAQILPRDLMTREAFENAISVIMAVGGSTNSVLHLLAVARTAGVALSIDDFERIRQRVPVICDLKPSGRFVTVDLHRAGGIPQVMKLLLDAGLLHGDCRTIEGKTLHEVLAAVPSVPPAGQEVIRPLSHPLYAKGHLAILKGNLAEEGAVAKISGVKNPVITGPARVFESEETCLAAILDKQINPGDVVVVRNEGPVGGPGMREMLSPTSAIVGQGLLDKVALITDGRFSGGSYGLVIGHVAPEAAVGGTIGLVQEGDSITVDANQLLIQLNVDESELAQRRAAWTQPEPRYRTGILGKYARQVSSSSVGAVTDQP

SEQ ID NO: 267 - DNA, 1617 bp, Synechococcus sp.
atgttgcgggccgtgggcttcggcgacggtgacttcaacaagccgatcatcggcatcgccaatggctacagcacgatcacgccctgcaacatcggcctgaacgatctggcccgctgcgccgaggagtctgcccgtctggctggggccatgccacagatgttcggcacgatcaccgtcagcgacgggatctcgatgggcaccgaggggatgaagtattccctggtgagccgggaggtgatcgctgattcgatcgaaaccgcctgcaacgcccagagcatggatggcctgctggccatcggcggctgcgataagaacatgcccggcgccatgctggcgatggcgcgcatgaacatcccggcgatcttcgtgtacggcggcacgatcaaacccggccggctcggcccctgcgacctcaccgtggtgagtgccttcgaggctgttggtcagttctcgggcggtcgcatcgatgaggaggaactgctggcgatcgagaagaacgcctgccccggcgccggcagctgcggcggcatgttcaccgccaacacgatgagttcggcgttcgaagcgatgggcctgagcctgccgggcagctccaccatgacggccgaggatccggagaaggccgagagcgctgcccgctccgccgaggtgctggtgcgggccatcgaggcgaacatccgcccccgtgatctgatcacccgcgaggcgatcgagaacgccatcagcgtgatcatggcggtgggggggtccaccaattcggtgctgcacctgctggcgatcgcccgcaccgccgaggtgccgctcacgatcgacgatttcgagacgatccgtcagcgggtgccggtgatctgcgatctcaagcccagcggccgtttcgtgacggtggatctgcaccgggccggcggcattccccaggtgatgaagctgctgctggatgccggcctgctgcacggcgattgccgcaccatcgaaggcctcacgctcaagcaggtgctggcggaggtgcccagcgagccccccgccgatcaggacgtgatccggcccctctccaatccgctctatgccaagggtcacctggcgatcctcaagggcaacctggccgaggaaggggccgtcgccaagatcagtggcgtcaagaccccggtgatcacggggccggcccgggtgttcgagagtgaggagagcgccctggaggcgatcctcgccggtgaggtccatgccggtgatgtggtggtggtgcgctacgagggcccggtgggcgggcccggcatgcgtgagatgctctcgcccacggccgcgatcgtgggccagggcctgggggaatcggtggcgctgatcaccgacggtcgcttcagcgggggctcctacggcctggtggtgggccatgtggcccccgaggccgccgtgggcggcaccatcgccctggtgcaggagggcgacagcatcaccgttgatgcccatcagctgctcatccagctcaatgtggaaaccagcgagctggagcggcgccgggcggcctgggtcaggcccgaaccgcgctaccgcactggagtgctgggcaagtacgcccggctggtgagcagcagcagcctgggggcggtcaccgatcagggttga

SEQ ID NO: 268 - protein, 538 aa, Synechococcus sp.
MLRAVGFGDGDFNKPIIGIANGYSTITPCNIGLNDLARCAEESARLAGAMPQMFGTITVSDGISMGTEGMKYSLVSREVIADSIETACNAQSMDGLLAIGGCDKNMPGAMLAMARMNIPAIFVYGGTIKPGRLGPCDLTVVSAFEAVGQFSGGRIDEEELLAIEKNACPGAGSCGGMFTANTMSSAFEAMGLSLPGSSTMTAEDPEKAESAARSAEVLVRAIEANIRPRDLITREAIENAISVIMAVGGSTNSVLHLLAIARTAEVPLTIDDFETIRQRVPVICDLKPSGRFVTVDLHRAGGIPQVMKLLLDAGLLHGDCRTIEGLTLKQVLAEVPSEPPADQDVIRPLSNPLYAKGHLAILKGNLAEEGAVAKISGVKTPVITGPARVFESEESALEAILAGEVHAGDVVVVRYEGPVGGPGMREMLSPTAAIVGQGLGESVALITDGRFSGGSYGLVVGHVAPEAAVGGTIALVQEGDSITVDAHQLLIQLNVETSELERRRAAWVRPEPRYRTGVLGKYARLVSSSSLGAVTDQG

SEQ ID NO: 269 - DNA, 1671 bp, Prochlorococcus marinus
atgctcagatccgccgccatcacaaagggaactcaacgctctcccaaccgagccatgcttcgcgcagtgggctttggcgacgaagacttcaataaaccaatcatcggtatagccaacggctacagcacgatcactccttgcaacatcggtcttaatgacctggcgcgacgttcagaagaagcagcccgccaggccggtgcaatgccccagatgttcggcaccatcactgtcagtgatggcatctctatgggcaccgaagggatgaaatattccctggtaagtcgcgaggtgattgctgattcgatcgagacagcctgcaacgcccaaagcatggacggcgtactagcaatcggtggctgtgacaaaaacatgcctggagcgatgatcgccctggcccgaatgaacatcccaggtgtctttgtctatggcggaacgatcaaaccaggaaaattggctgaccgcgacctcactgtagtcagcgcctttgaagctgttggtcagcatgccagtggcaagataaatgaggagcaactcaccgctatcgagaagaacgcttgcccaggagcaggaagttgcggtggcatgtttacagccaacacgatgtcagccgctattgaaacattgggattgagtttgccttacagctcaacgatggctgcagaggatgaggaaaaagcaaatagcgcagcccgtagtgctgaagtgcttgtggatgccattaaggcaaatatctgtccccgcgatctactcaccaagaacgcatttgaaaacgcgattagcgttgtcatggcagtgggcggctccaccaatgcagttctgcatctgcttgcgattgcccgtagcgcaggcgtagacctttgcatcgatgacttcgagcgcatccgccagcgtgtaccggtgatttgtgatctaaaacccagcggccgttacgtgactgttgatttgcataacgcaggcggcattccccaagtgatgaaacagttgcttgatgcaggcttacttcatggagactgccgcaatgtggaaggtaaaaccttgagagaactgctcaaggatgtgccatccgagccttcagcagagcaagacgtcattcatcccctctcgaaaccggtctatgccaaggggcacctggcgatccttaaaggcaatctggccagcgaaggatgcgtggccaagataagcgggatcaaaaccccagtacttactggacctgcaagggtttttgaaagcgaggaggcctgccttgctgccattctcaacaacaaggtgaaggcgggagatgtcgtcgtcatacgtaacgaaggcccggttggcgggcctggaatgcgagagatgcttgctcctacatctgccatcgtcggtgaagaccttggcgacaaggtggccttaatcacagatggacgcttcagcggaggtacctatggtttggtggtgggccatgtggcaccggaagcagccgtaggcggcatgattggccttgtgcaggaaggcgacagcatcaccatcgatgccaatcaactgctgatccaactcaatgtcgagaaggatgaattggagcgtcgctccagcgcatgggaaaaaacacagccgcgttatcaaacaggagttctcggtaaatacgcccgaatggtgagtagcgccagcaatggtgctgtcaccgaccagccctga

SEQ ID NO: 270 - protein, 556 aa, Prochlorococcus marinus
MLRSAAITKGTQRSPNRAMLRAVGFGDEDFNKPIIGIANGYSTITPCNIGLNDLARRSEEAARQAGAMPQMFGTITVSDGISMGTEGMKYSLVSREVIADSIETACNAQSMDGVLAIGGCDKNMPGAMIALARMNIPGVFVYGGTIKPGKLADRDLTVVSAFEAVGQHASGKINEEQLTAIEKNACPGAGSCGGMFTANTMSAAIETLGLSLPYSSTMAAEDEEKANSAARSAEVLVDAIKANICPRDLLTKNAFENAISVVMAVGGSTNAVLHLLAIARSAGVDLCIDDFERIRQRVPVICDLKPSGRYVTVDLHNAGGIPQVMKQLLDAGLLHGDCRNVEGKTLRELLKDVPSEPSAEQDVIHPLSKPVYAKGHLAILKGNLASEGCVAKISGIKTPVLTGPARVFESEEACLAAILNNKVKAGDVVVIRNEGPVGGPGMREMLAPTSAIVGEDLGDKVALITDGRFSGGTYGLVVGHVAPEAAVGGMIGLVQEGDSITIDANQLLIQLNVEKDELERRSSAWEKTQPRYQTGVLGKYARMVSSASNGAVTDQP

SEQ ID NO: 271 - DNA, 1671 bp, Prochlorococcus marinus
atgcttagatcaaatgcaataacacagggtattcaacgatcaccaaaccgagcaatgcttagagctgttgggtttgatgataatgattttaacaagccaatcattggaatagctaatgggcacagcacaataaccccatgcaatatgggattaatggatttagctaatagagcagagtcagcgttaaaagaggctggtgcaatgcctcaaactttcggaaccataactgttagtgacggcatttccatgggaacggaagggatgaaatactcattagtttcaagagaagttattgcagattcaatcgagacggcttgcaatgctcaaagcatggatggggtgttagcgataggtggatgcgataaaaatatgccaggagcaatgttatcaatggcaagaatgaacataccttcgatttttgtttatggggggacaattaaacctgggaaattagacggttgcgacttgaccgtggtgagttcatttgaggctgtcggtcaattagcaagcggaaaaatcgacaaagatcgtttaatagctgtagaaaaaaatgctatccctggaccaggcagttgcggagggatgtttactgctaataccatgtctgcggcaatagaaacgatgggttttagtttgccatttagttcaacaatggctgcagtagatgatgaaaaagcagaaagcgctgctgaaagtgctcaggtccttgtaaatgcagtaaagaataacatcaggccattagatttacttacgaaagaagcctttgagaatgcaatcagtgtcatcatggctgtaggcggctcaacaaattctgtccttcacctacttgctatagctaggactgcaggagttgatttaacgatcgatgactttgaacgtataaggcagactgttcctgtgatttgcgacctcaaaccaagcggtaaatacgtaacagtcgacctacataaagctggtgggattcctcaagtaatgaaattactcctcgatgcaggaatgctacatggagaatgcaaaaccattgaaggaaaaacaattaaagaagttcttagagatatcccctcaaagcccaaagaaaatcaagacgttataagacaaatatcaaaccctatttataaaaaaggacatcttgctattctcaaaggaaatttagcaagtgaaggaagtgtcgcaaaaattagtggtgtaaagactcccgttttaaccgggcctgcaagggtctttgagagtgaagaagaatgcttaactgccattcttgacaataaagtaaaagctggagatgtagtcgtcgttaggtatgaaggacctgtaggagggcctgggatgagggagatgctctctccaacctcagcgattgtaggtcaaggtttaggagagaaagttgcactaattactgatggtcgatttagtggaggatcatatggattagtggttggccacgttgctccagaagcagccgtcggaggaacaattggattagtagaggaaggagacagtattaccgttgacgctaataaattgttaattcaattaaatgtcgaagagcgagaactagctagaagaaaacagaaatgggagaagccaaagcctagatataagacaggcattcttgggaagtattccagattagtaagttcatcaagccaaggagcgacaactgatcaaatataa

SEQ ID NO: 272 - protein, 556 aa, Prochlorococcus marinus
MLRSNAITQGIQRSPNRAMLRAVGFDDNDFNKPIIGIANGHSTITPCNMGLMDLANRAESALKEAGAMPQTFGTITVSDGISMGTEGMKYSLVSREVIADSIETACNAQSMDGVLAIGGCDKNMPGAMLSMARMNIPSIFVYGGTIKPGKLDGCDLTVVSSFEAVGQLASGKIDKDRLIAVEKNAIPGPGSCGGMFTANTMSAAIETMGFSLPFSSTMAAVDDEKAESAAESAQVLVNAVKNNIRPLDLLTKEAFENAISVIMAVGGSTNSVLHLLAIARTAGVDLTIDDFERIRQTVPVICDLKPSGKYVTVDLHKAGGIPQVMKLLLDAGMLHGECKTIEGKTIKEVLRDIPSKPKENQDVIRQISNPIYKKGHLAILKGNLASEGSVAKISGVKTPVLTGPARVFESEEECLTAILDNKVKAGDVVVVRYEGPVGGPGMREMLSPTSAIVGQGLGEKVALITDGRFSGGSYGLVVGHVAPEAAVGGTIGLVEEGDSITVDANKLLIQLNVEERELARRKQKWEKPKPRYKTGILGKYSRLVSSSSQGATTDQI

SEQ ID NO: 273 - DNA, 1674 bp, Prochlorococcus marinus
atgaataaacttagatcatctgctattacccaaggtgtgcaaaggtcacctaacagatcaatgttaagggcagttggttttaatgatgaagattttaacaaacctattattggggttgccaatggttacagcacaataaccccatgcaatatagggttaaataaattagctctcaaagctgaagagtcaattagacgatcagggggaatgcctcaaaaattcgggaccatcactgtaagtgatggcatttccatgggaacagaggggatgaaatattcattagtttcaagagaagtaatagctgactcgattgaaacagcatgtaatgctcaaagtatggatgcagtacttgctataggtggatgcgataaaaatatgcctggagcaatgatagcgattgcgaggatgaatattccctcaatatttatctatggaggaactataaaaccaggcaaattacatggggaagatcttacggttgttagtgcgttcgaagctgttggacagttaacatcaggcaaaattaatgagaaaaggttaatcgaagttgagaaaaattgtatccctggagctggaagctgtgggggaatgtttacggctaatacaatgtctgcagtaatagaagtgttaggtttaagccttccacacagttcaactatggctgctgaagatcttgaaaaagaactaagtgcagaaaaaagtgctgagatattagtatctgcgattaaaaaaaatataagaccattagacttaatgactaaaaaagcatttgaaaatgcaatatcagtaattatggccgtaggaggttcaacgaatgcagtattacatatattagcaatagcaaatactgcaggtattgatattaatattgatgactttgagaggataagacaaaaagttcctgtaatttgtgaccttaagccaagtggaaaatttgtaacagttgatcttcataatgcagggggaattccccaagttatgaaaatactcctaaatgcaggattaattcatggggaatgcaaaaacattgaaggcaaaactataactgaatacttacaaaacattccagataagcctcctagtaatcaaaatgtcatccgaggaatagattatcccctttataaaaaagggcatttagcaattttaaaagggaacctggcaaaggaaggttctgtagcaaaaattagtggagtaaaaaatccagttttaacaggtccagcaaagatattcgagagtgaagaagattgtcttaaagcaatcttaaataacgaaattatagctggtgatgttgttgttgtaagaaatgaaggtcctgtcggaggtccagggatgagagaaatgttatccccaacatcagcaattgttggacaaggacttggagaaaaagtggccttaattactgatggtaggtttagcggtggctcttatggtcttgttgtcgggcatatagcccctgaagcagctgtcggtggaaacattgctctaataaaagaaggtgatttgattacagttgatgctgtaaagcaactaattgaggttgatttatctgacgaagaattagaaaaaagaaaaaataattgggtaaaacctaaacctaaatataaaagaggaatactttcaaagtattcgaaaatagtaagtacatcaagtttaggggctgttactgatttatag

SEQ ID NO: 274 - protein, 557 aa, Prochlorococcus marinus
MNKLRSSAITQGVQRSPNRSMLRAVGFNDEDFNKPIIGVANGYSTITPCNIGLNKLALKAEESIRRSGGMPQKFGTITVSDGISMGTEGMKYSLVSREVIADSIETACNAQSMDAVLAIGGCDKNMPGAMIAIARMNIPSIFIYGGTIKPGKLHGEDLTVVSAFEAVGQLTSGKINEKRLIEVEKNCIPGAGSCGGMFTANTMSAVIEVLGLSLPHSSTMAAEDLEKELSAEKSAEILVSAIKKNIRPLDLMTKKAFENAISVIMAVGGSTNAVLHILAIANTAGIDINIDDFERIRQKVPVICDLKPSGKFVTVDLHNAGGIPQVMKILLNAGLIHGECKNIEGKTITEYLQNIPDKPPSNQNVIRGIDYPLYKKGHLAILKGNLAKEGSVAKISGVKNPVLTGPAKIFESEEDCLKAILNNEIIAGDVVVVRNEGPVGGPGMREMLSPTSAIVGQGLGEKVALITDGRFSGGSYGLVVGHIAPEAAVGGNIALIKEGDLITVDAVKQLIEVDLSDEELEKRKNNWVKPKPKYKRGILSKYSKIVSTSSLGAVTDL

SEQ ID NO: 275 - DNA, 1674 bp, Prochlorococcus marinus
atgaataaactcagatcatctgcaataacccaaggtgtgcaaagatcacctaacagatcgatgttaagagctgttggatttaatgatgaagattttaataaacctattattggagttgcaaatggatacagcaccataacaccatgcaatatgggtttaaataagttagctctaaaagctgaagagtctataaaaagatcaggtgggatgcctcagatgtttgggactataacagtaagtgatgggatttctatgggaacagagggcatgaaatattccctagtttcaagagaagttattgctgattcaattgaaacagcatgcaatgctcagagtatggatggagtacttgctataggtggatgtgataaaaatatgccgggtgccatgattgcgattgcaagaatgaatattccatcaattttcatttatggaggaacaataaagcctgggaaattgcatggagaagatcttactgttgttagtgcatttgaagctgttggacaattaacatcaggcaaaattaatgaagaaaggctaatccaagttgagaaaaattgtattcctggtgctggtagctgtggaggaatgtttacagctaatacaatgtctgcggttattgaagtattagggttaagtcttcctcacagttccactatggctgctgaagatcttgaaaaagaactaagtgcagacaaaagtgctgagatattagtctccgcaatagaaaaagatataagacctctagacctaatgactaagaaagcatttgaaaatgcaatatcagtaattatggcaattggcggatcaacaaatgcggtattgcacatcttagctatcgcgaatactgcaggaatagatatcaacattaatgattttgagagaatcagacaaaaagtacccgttatttgtgaccttaaaccgagtggtaaatatgtgacggtggatcttcataaggcaggtgggattccacaagtaatgaaaatacttttgaatgcaggattaattcatggcgattgcaaaaacattgaaggaaaaaccatctcagaatacttacaaaatattccagataagcctccaacaaatcaaaatgtcataagagacatagataaccctctttataaaaaaggacatctagcgatattaaaaggtaacttagcgagcgaaggttctgtagccaaaattagcggagtaaaaaaccctgtattaacaggtcccgcaaaaatttttgaaagtgaagaagattgtttaaaatcgatattaaataacgatatcaaagctggtgatgttgttgttattagaaacgaaggtcctgtaggaggaccaggtatgagagagatgttagctccaacatctgcaattgttggtcaagggctaggagagaaggtggctttaattaccgatggcagatttagcggcggtacctatggtcttgttgtgggtcacatagctccagaggctgctgtaggaggaaatattgctctaataaaacaaggtgatttaattacagtagatgctgtaaaacaactaattgaagttgatttatctgacgaagaattagaaaaaagaaaaaaagattgggtaaaacctattcaaaaatacaaaagaggaattctttcaaaatattcgagaatcgtaagcacatcaagtttaggggctgttactgatttataa

SEQ ID NO: 276 - protein, 557 aa, Prochlorococcus marinus
MNKLRSSAITQGVQRSPNRSMLRAVGFNDEDFNKPIIGVANGYSTITPCNMGLNKLALKAEESIKRSGGMPQMFGTITVSDGISMGTEGMKYSLVSREVIADSIETACNAQSMDGVLAIGGCDKNMPGAMIAIARMNIPSIFIYGGTIKPGKLHGEDLTVVSAFEAVGQLTSGKINEERLIQVEKNCIPGAGSCGGMFTANTMSAVIEVLGLSLPHSSTMAAEDLEKELSADKSAEILVSAIEKDIRPLDLMTKKAFENAISVIMAIGGSTNAVLHILAIANTAGIDININDFERIRQKVPVICDLKPSGKYVTVDLHKAGGIPQVMKILLNAGLIHGDCKNIEGKTISEYLQNIPDKPPTNQNVIRDIDNPLYKKGHLAILKGNLASEGSVAKISGVKNPVLTGPAKIFESEEDCLKSILNNDIKAGDVVVIRNEGPVGGPGMREMLAPTSAIVGQGLGEKVALITDGRFSGGTYGLVVGHIAPEAAVGGNIALIKQGDLITVDAVKQLIEVDLSDEELEKRKKDWVKPIQKYKRGILSKYSRIVSTSSLGAVTDL

SEQ ID NO: 277 - DNA, 1680 bp, Prochlorococcus marinus
atgaataaattaagatcttctgcaataactcaaggtgttcaaagatctcctaacagatcaatgttaagagcagttggatttagtgatgatgatttcactaaaccaatcattggagtcgctaatggatatagcaccattacaccctgcaatatgggccttaacaagttagctcttaaggcagaagattcaataaggaaatcaggaggaatgcctcaaatgttcggaactatcaccgtaagcgatgggatctccatgggaacagaaggaatgaaatattctttagtttcaagggaagtaatagccgattcaatagaaactgcctgtaatgcgcaaagtatggatggtgttttagctattggtggttgtgataaaaatatgccgggtgcaatgatagcaattgcaagaatgaatatcccttccatatttatttatggaggaacaataaaacctggaaagttaaacggtgaagacttaacggttgtcagtgcatttgaagctgttgggcaattaacctcgggtaaaataaatgagaagagattaaatgaagttgagaaaaattgtattccaggagcaggaagttgtggaggaatgttcacagctaatactatgtcagcagttatagaagtcttaggtttaagtcttcctcatagttcaacaatggcagccgaagattatgagaaggtggtaagtgctgaaaaaagcgctgaaatacttgtagatgcaataaaaaaagatataaggccactagatcttatgactaaagaatcttttgaaaatgcaatatctgtaattatggctattggaggttcgacaaatgcagtgcttcacatattagcgatagcgaatactgcaggtatagagatcaatattgatgattttgaaagaataagacaaaaagttcctgtgatttgtgatttgaaacctagcggcagatatgtcacagtagatcttcataatgcaggaggcattccacaagtaatgaaaatacttttaaatgcaggattaataaatggtgattgcaaaaatatcgaaggtaaaacaatatctgaatatttacttaatattccagataatcctcctgaaaatcaaaatgttattagaaacataaataatcctctttataaaaaaggtcatttagcaatattaaaaggtaatttagcttcggaaggttgtgtagcaaaaatcagcggagtaaagaatccagttttaaagggtcccgctcgaatttttgaaagtgaggaagattgtcttaaatcaattttgaataatgatattaaagctggtaatgttgtcgttataagaaatgaaggtcctgtgggaggaccgggaatgagagaaatgttagctccaacatctgcaattgttgggcaagggctgggagaaaaagtagctttaataactgatggtagatttagtggaggtacctatggccttgttgttggacatatcgcaccagaggcagcagtaggagggaatatagctttaataagagagggagatttaatcactgttgatgctgtaaaccaattaattgaagttgaactatctgatggggaattagaaaaaagacgaattaactggataaagcctattccgaaatataagaaaggtgtactttcaaaatattcaagaattgtaagtacttcaagcttaggtgcagttacagatctggaaaaataa

SEQ ID NO: 278 - protein, 559 aa, Prochlorococcus marinus
MNKLRSSAITQGVQRSPNRSMLRAVGFSDDDFTKPIIGVANGYSTITPCNMGLNKLALKAEDSIRKSGGMPQMFGTITVSDGISMGTEGMKYSLVSREVIADSIETACNAQSMDGVLAIGGCDKNMPGAMIAIARMNIPSIFIYGGTIKPGKLNGEDLTVVSAFEAVGQLTSGKINEKRLNEVEKNCIPGAGSCGGMFTANTMSAVIEVLGLSLPHSSTMAAEDYEKVVSAEKSAEILVDAIKKDIRPLDLMTKESFENAISVIMAIGGSTNAVLHILAIANTAGIEINIDDFERIRQKVPVICDLKPSGRYVTVDLHNAGGIPQVMKILLNAGLINGDCKNIEGKTISEYLLNIPDNPPENQNVIRNINNPLYKKGHLAILKGNLASEGCVAKISGVKNPVLKGPARIFESEEDCLKSILNNDIKAGNVVVIRNEGPVGGPGMREMLAPTSAIVGQGLGEKVALITDGRFSGGTYGLVVGHIAPEAAVGGNIALIREGDLITVDAVNQLIEVELSDGELEKRRINWIKPIPKYKKGVLSKYSRIVSTSSLGAVTDLEK

SEQ ID NO: 279 - DNA, 1680 bp, Prochlorococcus marinus
atgaataaattaagatcatctgcaataactcaaggtgtccaaagatctcctaacagatcaatgttaagagctgttggttttagtgatgaagattttactaaacctataattggagttgctaacggatttagtactatcacaccatgcaatatgggtctaaacaagttagctctaaaagctgaagaatcaataagagaagcaggaggtatgcctcagatgttcggaaccatcaccgtaagtgatggaatctctatgggaacagagggaatgaaatattccctagtttcaagagaggttatagctgattcaatcgaaacagcatgcaatgcgcaaagtatggatggggttttagctattggaggttgtgataaaaatatgccaggagcaatgattgcaattgcaagaatgaatatcccatccatatttatttatggaggaacaataaaacctggtaaattaaatggtgaagatcttacagttgtcagtgcatttgaagctgttgggcaattaacttctgggaaaataaatgagaagagattaattgaagttgaaaaaaattgtatcccaggagctggaagttgtggaggaatgtttacagctaacactatgtctgctgttatagaagtcttgggtttaagtcttccatatagttcaacaatggcagctgaagattacgaaaaggaagttagcgctgaaaaaagtgctgaaatattagttgatgcaattagaaaagatattagacctttaactctcatgactaaagaatcatttgagaatgcaataactgtcattatggctattggaggttcaactaatgccgttctccatatattagcaatagcaaatacagcaggtatagatatcaatattgatgatttcgaaagaataagacaaaaagtacctgtaatttgcgacttaaaacccagcggtaaatacgtaacagtcgatcttcataaagcaggtggaattccacaagttatgaaaatacttctaaacacaggtttgatacatggtaattgtagaaacatagagggtaaaacagtagttgaatccttaaaagatattccagttaaacctccagagaatcaggatgtcattcgagatattgataatccactttataaaaaaggtcacttagcgattctaaaagggaacttagcctcggaaggttgtgtagccaaaattagtggaataaagaatcctgtattaaaaggacctgctcgcatctttgagagtgaggaggattgtctcaaatcaattttgaataatgatattaaagctggtaatgttgttgttataagaaatgaaggtcctgtgggcggaccagggatgagagaaatgttggcaccaacatccgcaattgttgggcaaggacttggagaaaaagtagcgctaataactgatggtagatttagtggaggcacctatggcctagttgttggccacattgcaccagaggcagcagttggaggaaatatagcgttaataaaagaaggcgatttaataactgttgatgctacaaaccaattaatcgaagttgaactatctgatgaggaattagaaatgagaagaattaactgggaaaagcctagtaaaaaatataaaaaaggagttctttctaaatattcaagaattgttagcacctcaagcctaggagccgttacagatttggaagaataa

SEQ ID NO: 280 - protein, 559 aa, Prochlorococcus marinus
MNKLRSSAITQGVQRSPNRSMLRAVGFSDEDFTKPIIGVANGFSTITPCNMGLNKLALKAEESIREAGGMPQMFGTITVSDGISMGTEGMKYSLVSREVIADSIETACNAQSMDGVLAIGGCDKNMPGAMIAIARMNIPSIFIYGGTIKPGKLNGEDLTVVSAFEAVGQLTSGKINEKRLIEVEKNCIPGAGSCGGMFTANTMSAVIEVLGLSLPYSSTMAAEDYEKEVSAEKSAEILVDAIRKDIRPLTLMTKESFENAITVIMAIGGSTNAVLHILAIANTAGIDINIDDFERIRQKVPVICDLKPSGKYVTVDLHKAGGIPQVMKILLNTGLIHGNCRNIEGKTVVESLKDIPVKPPENQDVIRDIDNPLYKKGHLAILKGNLASEGCVAKISGIKNPVLKGPARIFESEEDCLKSILNNDIKAGNVVVIRNEGPVGGPGMREMLAPTSAIVGQGLGEKVALITDGRFSGGTYGLVVGHIAPEAAVGGNIALIKEGDLITVDATNQLIEVELSDEELEMRRINWEKPSKKYKKGVLSKYSRIVSTSSLGAVTDLEE

SEQ ID NO: 281 - DNA, 1671 bp, Prochlorococcus marinus
atgcttcgatccagtgcaatcacccaaggaattcagagatcaccaaatagggctatgctccgagcggttggatttaatgataatgattttaacaagccaataattggtattgctaatgggtacagcacaattacaccatgcaatgttggattaaataacctagccctacacgcagaagcctcaacaaaagtatcaggcgctatgccacaaatgtttggcacaataactgttagcgatggaatatctatggggaccgaagggatgaaatattcactagtttcaagagaggttatagccgattcaatagagacagcatgtaatgctcaaagcatggacggtgttcttgcaataggaggatgtgataaaaatatgcctggagccatgattgccatggcaagaatgaatatacccgcaattttcgtgtatggagggacaattaaaccagggaaattagacggttgtgatttaacagtagtaagtgcatttgaagccgttgggcaattaacaagtggaaagattactgaagataaacttattgctgtagaaaagaattgtattcctggagcaggaagttgtggaggaatgttcacagctaataccatgtccgcagcaatagaaacgctcggattaagcttgccttatagctcaacaatggctgctgaagataaggaaaaaatagagagtgctgagcgtagtgccaaagtcctggtagatgcaattgaaaaaaatatacgtcctttagacctcctaaccaagaaatcatttgaaaatgctattgccgtagtcatggctgttggcgggtcgacaaatgccgtattacatttattagctattgctaggtcatcaggagtggacttatgcatagatgattttgaaagaattcgacagaaggtacctgtgatttgtgatttaaagccaagtggcaaatatgtcactgtagatctacataaagctggtggaatacctcaggtaatgaagctgcttttagatgcgggcttattacatggtgattgtttaactattgaaggtataactatcgatgagtccttaaaaaatatcccttcagagccaccagcgaaccaaaatgtgatatctccaatcacaaagccaatatataaaaaaggacatctagcaatcttaaaaggaaatctcgcaaccgaaggatgcgtagccaaaataagtgggattaggaccccagtgttgaaaggtccagcaaaagtatttgaaagtgaagaagactgtctcgacgcaatcttaaaagaacagatacaagaaggagatgtaatagttattagaaacgaaggccctgtaggaggacccggaatgagagaaatgttagcaccaacctctgccatagttggacaaggcctaggggataaggttgctctaataacagatggacgttttagcggtggtacttatggtttggtagtgggacatatagcaccagaagcatcagtgggagggaatatagccctagtcaaagaaggtgacatgattactgttgacgcgcacaaaaagttgattcaattggaagtagatgaaaaggagctctcaaaaaggaggactttatgggaaaaaccagaagttaaatataagactggaatactaggtaaatatgcgcgtttagttagcagttcaagcaagggtgctgtaactgatcaaccatga

SEQ ID NO: 282 - protein, 556 aa, Prochlorococcus marinus
MLRSSAITQGIQRSPNRAMLRAVGFNDNDFNKPIIGIANGYSTITPCNVGLNNLALHAEASTKVSGAMPQMFGTITVSDGISMGTEGMKYSLVSREVIADSIETACNAQSMDGVLAIGGCDKNMPGAMIAMARMNIPAIFVYGGTIKPGKLDGCDLTVVSAFEAVGQLTSGKITEDKLIAVEKNCIPGAGSCGGMFTANTMSAAIETLGLSLPYSSTMAAEDKEKIESAERSAKVLVDAIEKNIRPLDLLTKKSFENAIAVVMAVGGSTNAVLHLLAIARSSGVDLCIDDFERIRQKVPVICDLKPSGKYVTVDLHKAGGIPQVMKLLLDAGLLHGDCLTIEGITIDESLKNIPSEPPANQNVISPITKPIYKKGHLAILKGNLATEGCVAKISGIRTPVLKGPAKVFESEEDCLDAILKEQIQEGDVIVIRNEGPVGGPGMREMLAPTSAIVGQGLGDKVALITDGRFSGGTYGLVVGHIAPEASVGGNIALVKEGDMITVDAHKKLIQLEVDEKELSKRRTLWEKPEVKYKTGILGKYARLVSSSSKGAVTDQP

SEQ ID NO: 283 - DNA, 1677 bp, Prochlorococcus marinus
atgaagcttagatcaagcgcaataactcaaggcgtacagagatcgccaaacagagcaatgcttcgtgctgttgggtttgaagacgatgatttcaacaaaccaataataggtattgcaaatgggtatagcactatcacgccttgtaatattgggctaaatgatttggcaaaacaagcagaaaaagcaataaaggattgggatggtatgcctcaaatgtttggaacaattactgttagtgatggaatatctatggggactgaagggatgaaatactccttggtctctagagaagtaatagccgattcaatagaaactgcatgcaatgctcaaagcatggatggagtgttagcaataggtggttgcgataaaaacatgcctggtgcaatgctagccatggcaagaatgaatattccagggatatttgtttatgggggaacgatcaaaccaggaaaattaaatggcgaggatttgacagttgtaagtgcatttgaagctgtggggcaattaactagtgggaaaataacaaaagaaaaattgattgaggttgaaaaacattgcattccaggggctggtagttgtggaggtatgtttacagcaaacacaatgtcagcagccattgaagctatgggactaagtcttcctcacagttcaaccatggctgctgaggatcaagaaaaaataaaaagtactcaaaaaagtgccgaggttcttattaaagctatcaaggaaaatattcgcccattagatttattaaccaagcaagcattcgagaatgcaataagtgtagtaatggcagttgggggctctacaaatgctgtgcttcatcttttagcaattgctcattcatcgggagttgaactttctcttgacgaatttgaaaagatacgtcaacgagttccggtactttgtgatttaaagcccagtggtaaatatgtgactgttgacctacacaaagcaggaggcattccacaagtcatgaaaatacttcttgaagcaggattgattaatgaaaattgtagaacaatagaaaacaaaacaatcaaggaaatgctgctcgatgttcccgcagagcccccatcagatcaggatgttattcggcctttcgattcgccggtctataaaaaaggtcatttagcaattctcaaaggaaatcttgcaactgagggaagcgttgcaaaaatcagtggtataaaagaaccaatccttacaggtccagcaaaagtatttgaaagtgaagaagattgcttaaaagcaatacttactgaacaaattcactcaggtgatgtagtagtcataagaaatgaaggcccagttggtgggccagggatgagagaaatgctcgctccaacatctgcaattgttggtcaaggtcttggtgaaaaagttgctttaattactgacggacgttttagtggcggaacatatggactagtagttggtcatgtcgcaccagaagcagccgttggagggaatattgctctaattcaagatggtgacagcataactgttgatgctattcaaaaactcattcaagtaaatatcgaagaagcagaattaaaaagacgacgttcactttgggttaagccaaagcccaaatacaattcaggagttcttgggaaatatgcaactttggttagtagttcaagcaaaggtgctgtaactgatcagaactgttaa

SEQ ID NO: 284 - protein, 558 aa, Prochlorococcus marinus
MKLRSSAITQGVQRSPNRAMLRAVGFEDDDFNKPIIGIANGYSTITPCNIGLNDLAKQAEKAIKDWDGMPQMFGTITVSDGISMGTEGMKYSLVSREVIADSIETACNAQSMDGVLAIGGCDKNMPGAMLAMARMNIPGIFVYGGTIKPGKLNGEDLTVVSAFEAVGQLTSGKITKEKLIEVEKHCIPGAGSCGGMFTANTMSAAIEAMGLSLPHSSTMAAEDQEKIKSTQKSAEVLIKAIKENIRPLDLLTKQAFENAISVVMAVGGSTNAVLHLLAIAHSSGVELSLDEFEKIRQRVPVLCDLKPSGKYVTVDLHKAGGIPQVMKILLEAGLINENCRTIENKTIKEMLLDVPAEPPSDQDVIRPFDSPVYKKGHLAILKGNLATEGSVAKISGIKEPILTGPAKVFESEEDCLKAILTEQIHSGDVVVIRNEGPVGGPGMREMLAPTSAIVGQGLGEKVALITDGRFSGGTYGLVVGHVAPEAAVGGNIALIQDGDSITVDAIQKLIQVNIEEAELKRRRSLWVKPKPKYNSGVLGKYATLVSSSSKGAVTDQNC

SEQ ID NO: 285 - DNA, 1707 bp, Nodularia spumigena
atggaaggaaaaaaaatgtcggagaatttaagaagccaagttgttacccaaggagtgcagcgatcgcctaatcgagctatgctgcgtgcagtgggttttaaggacgaagattttaataaagccattgtcggcattgctaatggctacagtacaatcactccctgcaatatgggaattaataaactagcactaagagccgaaattggcgtaagagaagctggggcaatgccgcaaatgttcggtactatcaccattagtgatgggatttctatgggaaccgaggggatgaaatattccctagtgtcacgagaagttattgctgattccattgaaaccgcctgtactggacaaagtatggatggcgttttggctattggtggctgtgataaaaatatgccaggggcaatgctagcgatggcgcgcatgaatattcctgctatttttgtttatggtggcacaattaaacccggtcactacgatggtaaagatttaaccgtcgtgagttcctttgaagcagttggtcaatacagcgccggtaaaattgatggtgatgaactcttagcagtggaacgtgaagcttgtcctggtgctggttcctgcggtgggatgtttacagcaaataccatgtcttccgcttttgaagcaatgggcatgagcttaccttattcttccacaatggcagccgaagatgctgaaaaagccgacagtacgcaaaaatcagcagttgctttagtagaagccatacgtaagcaaatcttacctcggcagattatcacccgtaaatctatagaaaatgccatttcagtaattatggcagtgggtggttccacaaatgcagtattgcactttttagcgatcgctcgtgcagctggagtagaactcacactagatgattttgaaaccatccgtggacgtgtcccagttatctgtgatttaaaacccagtggtaaatatgtcgccacagacctgcacaaagctggcggaatacctcaagtcatgaaaatgttacttgtgcatgatttactccacggcgactgcttaactatcacaggtaaaacagtagcagaagtcttagcagatatctccgcagaaccacgtaccgaccaagatgtgattcgtccttggaataaccccatgtatgctcaaggacacttagccatcctcaaaggcaacctagccacagaaggggctgtagccaaaatcaccggagttaaaaagccgattattactggccctgcacgggtatttgagtctgaggaatcctgtttagatgccatcctcgcaaataaaattaatgccggggatgttctcataattcgttacgaaggtcccaagggtggccctggtatgagagaaatgcttgctcccacctcagcaattattggggctgggttaggcgatgcagtaggtttaattactgatgggcgcttttccggcggtacttacggcatggtagttggtcacgtagccccagaagcagccgttggtggtgcgatcgctcttgtagaagaaggtgatagcattaccattgatgcctctaatcgcctcttgcaattgaacgtctcagatgaagaattagcccgtagacgtgccaattggcaaccccttccaccccgttacaccaaaggcgtacttgctaaatatgccaaattagtatcttctagcagtgttggagcagtcacagatttagacttatttaatggttag

SEQ ID NO: 286 - protein, 568 aa, Nodularia spumigena
MEGKKMSENLRSQVVTQGVQRSPNRAMLRAVGFKDEDFNKAIVGIANGYSTITPCNMGINKLALRAEIGVREAGAMPQMFGTITISDGISMGTEGMKYSLVSREVIADSIETACTGQSMDGVLAIGGCDKNMPGAMLAMARMNIPAIFVYGGTIKPGHYDGKDLTVVSSFEAVGQYSAGKIDGDELLAVEREACPGAGSCGGMFTANTMSSAFEAMGMSLPYSSTMAAEDAEKADSTQKSAVALVEAIRKQILPRQIITRKSIENAISVIMAVGGSTNAVLHFLAIARAAGVELTLDDFETIRGRVPVICDLKPSGKYVATDLHKAGGIPQVMKMLLVHDLLHGDCLTITGKTVAEVLADISAEPRTDQDVIRPWNNPMYAQGHLAILKGNLATEGAVAKITGVKKPIITGPARVFESEESCLDAILANKINAGDVLIIRYEGPKGGPGMREMLAPTSAIIGAGLGDAVGLITDGRFSGGTYGMVVGHVAPEAAVGGAIALVEEGDSITIDASNRLLQLNVSDEELARRRANWQPLPPRYTKGVLAKYAKLVSSSSVGAVTDLDLFNG

SEQ ID NO: 287 - DNA, 1701 bp, Nostoc punctiforme
atgtcggagaatttgagaagccaagtagtgacgcaaggagtgcagcgatcgccaaatcgagctatgctgcgggcagttggttttaaagatgaagatttcaataaagccattgtcggtatagccaacggttacagcacgatcaccccctgcaatatggggataaatcaactggcacagagggcagaagctgggattaaaaccgccggagcaatgccgcaaatatttggcacaattaccatcagcgacgggatttcaatgggaaccgaagggatgaaatattccctagtatcgcgggaagttatcgccgattccatcgaaaccgcctgtaccggacaaagtatggatggtgtactagccattggtggctgtgataagaatatgccaggcgcaatgctagcgatcgcgcggatgaatatcccggcaatattcgtttacggtggcacaattaaacccggtcactacaacggacgcgatttaaccgttgtcagttcttttgaagctgttggtcaatacagtgcgggaaaaattgacgacaaggaattattagaagtcgaaagtcgcgcttgtcctggcgctggttcctgcgggggaatgttcacagctaacaccatgtcttcagcatttgaagcgatgggaatgagtttaccctattcttccacaatggcagccgaagatgccgaaaaagccgacagcacggaaaaatcagcctttgtgctagtcgaagccatcaagaagcaaatcttaccccggcaaattatcacccgtaaatctatagagaatgccatctctgtgattatggcggtgggtggttcgaccaatgcagtattgcatttcttagcgatcgcccgcgctgcgaatgtagagttaaccctagatgactttgaaacaatccgcgcccgtgttcccgttttgtgcgatctaaaaccaagcggtaaatatgtcgctacagatttgcacaaagctggtggcattccgcaagtcatgaagatgctactcgcacatggcttattgcatggtgatagtctcaccattagcggtcaaaccattgcagagatattagcagacatacccgaagagccatctgccaatcaagatgtgattcgggcttggaataacccgatgtatgctcaaggacatttagccatcctcagaggtaatctggcaacggaaggggctgtcgctaaaattaccggcgtgaaaaaaccagtcattaccgggcctgcacgggtgtttgagtcggaagaagcctctttagatgcaattttggcgggtaaaattcaagctggtgatattttggttattcgctacgaagggcccaaaggcggccctggaatgcgagaaatgttggctcccacttcggcaattatcggggctggcttgggtgatgcggtgggattaattaccgatgggcgcttttctggcggtacttatggcatggtggttggtcatgttgctccagaagcagcagtgggtggtgcgatcgcgcttgttgaagaaggcgatagtattaccattgatgcacccgcacgccttttgcagttgaatatatctgaagaagaattagctcgtcgtcgtgctaattggcaacctcccgctccacgttacaccaaaggcgtgttggcgaaatatgccaaactggtatcttctagcagcatcggtgctgtgacagatttggatttgttcaaaccacaacagaactaa

SEQ ID NO: 288 - protein, 566 aa, Nostoc punctiforme
MSENLRSQVVTQGVQRSPNRAMLRAVGFKDEDFNKAIVGIANGYSTITPCNMGINQLAQRAEAGIKTAGAMPQIFGTITISDGISMGTEGMKYSLVSREVIADSIETACTGQSMDGVLAIGGCDKNMPGAMLAIARMNIPAIFVYGGTIKPGHYNGRDLTVVSSFEAVGQYSAGKIDDKELLEVESRACPGAGSCGGMFTANTMSSAFEAMGMSLPYSSTMAAEDAEKADSTEKSAFVLVEAIKKQILPRQIITRKSIENAISVIMAVGGSTNAVLHFLAIARAANVELTLDDFETIRARVPVLCDLKPSGKYVATDLHKAGGIPQVMKMLLAHGLLHGDSLTISGQTIAEILADIPEEPSANQDVIRAWNNPMYAQGHLAILRGNLATEGAVAKITGVKKPVITGPARVFESEEASLDAILAGKIQAGDILVIRYEGPKGGPGMREMLAPTSAIIGAGLGDAVGLITDGRFSGGTYGMVVGHVAPEAAVGGAIALVEEGDSITIDAPARLLQLNISEEELARRRANWQPPAPRYTKGVLAKYAKLVSSSSIGAVTDLDLFKPQQN

SEQ ID NO: 289 - DNA, 1692 bp, Nostoc sp.
atgtcggagaattttagaagcaaggctatcacacaaggggtacagcgatcgcctaacagagcaatgctgcgggctgttggttttcaggatgcagattttaccaaagccattgtaggtgttgccaatggttacagcacgattaccccgtgtaatatggggataaatcaactagcacaaagggcagaagctggtataaatactgctggagcaaagccgcaaatattcggtacaattacgattagtgatgggatttcgatgggaaccgaagggatgaaatattccctggtatcacgagaagtaatcgctgactccattgaaaccgtttgtaatgggcaaagtttagacggggtaattgccattggtggctgtgataagaatatgccaggggcaatgattgcgatcgcccggataaatatccctgctatctttgtttacggtggcacaattaaacccggacattacaacggtaaagatttaactgttgtcagttcttttgaggctgttggtgagtacagcgccggtaaaattgacgaaaatgaactgttagcagtagaacgcaatgcttgtcctggtgcaggttcctgcggtgggatgtacacagcaaataccatgtcctctgcttttgaagcactggggatgagtttgccctattcgtctacaatggcggcagaagatgacgaaaaagctgatagtacggaagaatcagccaaggtattggtagaggcgattcgtcatcaattattacccagacagattatcactcgtaagtccatagaaaacgccatatctgtaattatggctgtgggtggttctactaatgcggtgttacattttctagcgatcgcccgtgcggctggtgtagaactaaatctggacgactttgaaactattcgtggtcgtgtccccgttttgtgcgacttgaaaccaagcggtagatatgtggctacagacctgcacaaagctggtggtataccccaagtcatgaaaatgttactcgtgcatggtttactccacggcgactgtatgaccatcacaggtaaaaccattgccgaagttttagcagatatcccagaagaaccatcgcctaatcaagatgtaattcgtccttggaataaccccatgtatgcccaaggccacttggctatactcaaaggtaatttggcaacagaaggcgcagttgccaaaattactggtgtgaaaaatcctgtgattacagggccagccaaagtatttgaatcagaagaggattgtttagatgcaattttggcaggtaaaattaaagccggtgacgtgattgtcatccgctacgaaggccccaaaggcggccctgggatgcgagaaatgttagcccccacctcagctattatcggtgcaggtttaggcgactcagtgggactaattaccgatggacgcttctccggtggtacttacggtatggttgtgggacacgttgcaccagaagcagccgttggtggggcgatcgctctggtacaagaaggtgatagcatcacaattgatgcccacgcccgttctttgcagttgaacatatcagacgaagaattaacccgtcgtcgtgccaattggcaaccccgtcccccacgttacactacaggcatactggcaaaatacgccaagttggtagcttctagtagtgtgggtgctgtcaccgatttagacttattcaataaatag

SEQ ID NO: 290 - protein, 563 aa, Nostoc sp.
MSENFRSKAITQGVQRSPNRAMLRAVGFQDADFTKAIVGVANGYSTITPCNMGINQLAQRAEAGINTAGAKPQIFGTITISDGISMGTEGMKYSLVSREVIADSIETVCNGQSLDGVIAIGGCDKNMPGAMIAIARINIPAIFVYGGTIKPGHYNGKDLTVVSSFEAVGEYSAGKIDENELLAVERNACPGAGSCGGMYTANTMSSAFEALGMSLPYSSTMAAEDDEKADSTEESAKVLVEAIRHQLLPRQIITRKSIENAISVIMAVGGSTNAVLHFLAIARAAGVELNLDDFETIRGRVPVLCDLKPSGRYVATDLHKAGGIPQVMKMLLVHGLLHGDCMTITGKTIAEVLADIPEEPSPNQDVIRPWNNPMYAQGHLAILKGNLATEGAVAKITGVKNPVITGPAKVFESEEDCLDAILAGKIKAGDVIVIRYEGPKGGPGMREMLAPTSAIIGAGLGDSVGLITDGRFSGGTYGMVVGHVAPEAAVGGAIALVQEGDSITIDAHARSLQLNISDEELTRRRANWQPRPPRYTTGILAKYAKLVASSSVGAVTDLDLFNK

SEQ ID NO: 291 - DNA, 1686 bp, Trichodesmium erythraeum
atgccagagaatttgagaagtcaattagtcaccaaaggagtacaacgcgctcccaaccgagctatgctgagagctgtgggttttgaagattcagactttaccaaaccaattattggggttgccaatgcccatagcactattactccctgcaacatgggtattaatgatttggccatgagagctgtaagtggagtgaaagaagctggaggaatgccgcagatatttggaactattactattagcgatggaatttctatgggtactgaggggatgaaatattctctggtttctagagacgttattgctgattccatcgaaacagtttgtaatggccaaacaatggatggagttctagctattggtggatgcgataaaaatatgccaggagcaatgatagcgatcgctaggatgaatattcctgctatcttcgtatacggtggtactattaaaccaggcaactacaacggtaaagacctaacagttgtaagtgcttttgaagcagtgggagaatatagtgctggaaaaattgacgaaacagaattaacagaagttgaacgtagagcttgccctggtgctggttcctgtggaggaatgtttactgccaatactatgtcttcagcttttgaagcaatgggtatgagtctcatgtattcatcaacaatggctgcagaagatgcagaaaaagcagatagcacagaaaaatcagctcatgttttagtagaagctattcgcaaacaaattttacctagtcaaattattacccgtaaagctatcgaaaatgcaatttcagtaattatggctgtagggggttccactaatgcagtactacacctattagcaattgcttatgctgcaaatgtgaagttatctttagatgattttgaaataattagggccagagtacctgtattatgtgatttgaaacctagtggtaaatacgttacaacaaatttgcatcaagcgggtggaattcctttagtaatgaaaatgcttttagaacatgatttactccacccagatgctttaaccataacaggtaagactattggagagcaattaacaaatataccttctgaaccaccttctaatcaagacgtgattcgcccttggaataatcctatgtatgctcaaggacacttggctattttaaaaggaaatttggcgacagagggagcagttgctaaaattacaggagtgaagaacccagaaataacaggactagcaagagtatttgattcggaagaagcttgtttagaagcaatattagcagggaaaattcaagcagggaatattattgtagttcgctatgaaggtccaaaaggtggaccaggtatgcgagaaatgttagcaccaacttcggctattattggtgctggtttgggggataaagtgggattaattactgatggtaggttttctggtggtacttatggtatggtggttggtcatgtagctccagaagctgcagtaggtggcacgatcgctctagttaaggaaggagatatgattactattgatgctcataagcgtttactacagttaaatatttctgatgaggaattagaaaagcgtcgtcaagtatggaaaccacgaaaaccccaatatactagaggtgtattagctaaatatgctaagttagtttcttctagcagtgttggagcagtaactgacgctggattaggttga

SEQ ID NO: 292 - protein, 561 aa, Trichodesmium erythraeum
MPENLRSQLVTKGVQRAPNRAMLRAVGFEDSDFTKPIIGVANAHSTITPCNMGINDLAMRAVSGVKEAGGMPQIFGTITISDGISMGTEGMKYSLVSRDVIADSIETVCNGQTMDGVLAIGGCDKNMPGAMIAIARMNIPAIFVYGGTIKPGNYNGKDLTVVSAFEAVGEYSAGKIDETELTEVERRACPGAGSCGGMFTANTMSSAFEAMGMSLMYSSTMAAEDAEKADSTEKSAHVLVEAIRKQILPSQIITRKAIENAISVIMAVGGSTNAVLHLLAIAYAANVKLSLDDFEIIRARVPVLCDLKPSGKYVTTNLHQAGGIPLVMKMLLEHDLLHPDALTITGKTIGEQLTNIPSEPPSNQDVIRPWNNPMYAQGHLAILKGNLATEGAVAKITGVKNPEITGLARVFDSEEACLEAILAGKIQAGNIIVVRYEGPKGGPGMREMLAPTSAIIGAGLGDKVGLITDGRFSGGTYGMVVGHVAPEAAVGGTIALVKEGDMITIDAHKRLLQLNISDEELEKRRQVWKPRKPQYTRGVLAKYAKLVSSSSVGAVTDAGLG

SEQ ID NO: 293 - DNA, 1686 bp, Acaryochloris marin
atgtctgacaatcgaaatagccaagtcgtcactcaaggagttcaacgagcccccaaccgggccatgctaagggctgtgggctttggagatgatgattttaccaagccgattgttgggttagcgaatggttttagtacgattaccccttgtaatatgggcatagactctctggctacacgggcagaggccagtatcagaacggctggagccatgccgcaaaagtttggcaccatcactatcagtgacggcatttccatgggcacggaagggatgaaatattccttggtgtcccgggaagtgattgcagactccatcgagacggcctgtatgggccaaagtatggatggagtactcgccattggcggctgtgataaaaatatgccgggggctatgctcgccatggctcggatgaatattccggccatctttgtttacggcggcacgatcaaacccggacatctaaatggtgaagacttaaccgtggttagtgcctttgaagctgtgggtcagcatagtgctggacggattagtgaagccgagttaacggcagtggagaaacatgcttgtccgggtgctggatcctgtggcggtatgtatacggccaacaccatgtcttctgcgtttgaggcaatgggcatgagcctgatgtattcttccaccatggcagcggaagatgaagaaaaagccgtcagtgcagaacagtctgccgctgttttagtggaagcgatccacaagcaaattctgccccgcgatatcttgacccgcaaagcctttgaaaatgccattgctgtgattatggctgtaggcggatccaccaatgccgttctccacctgttggccatttcccgcgcggctggagactccctgaccctagatgacttcgaaaccatccgggctcaagttccagtgatctgcgatctcaaaccatcaggtcgctatgtagccacagatctccataaagcaggtggaatcccattggtgatgaaaatgctattggaacatggtcttctccatggtgatgctctgaccattacgggtaaaaccattgctgagcagttggctgatgtcccatcagagccttcccccgatcaggatgtaattcggccttgggacaatcccatgtataaacaaggccacctcgccatcctccggggtaacttggccacggaaggagcggttgccaaaatcacaggcattaaaaatccccaaattacgggtccagctcgggtatttgaatcggaagaggcttgcttggaggcgattttggcaggcaagattcagcctaatgatgtgattgtggtgcggtatgaaggcccgaagggtgggccgggaatgcgagagatgttagctcccacgtccgcgattattggggcaggtttgggtgattcagttggattgattacggatggtcgcttttctggtggaacttacggcatggtggttgggcatgtggccccagaagctgcggtgggtggtacgattgcccttgtgcaggaaggcgatcagattacaattgatgcccatgctcgaaagttggagctgcatgtgtctgatcaggagttaaaagagcggaaggagaagtgggagcaaccaaaacctctctataacaaaggggttttggcaaagtatgccaagttagtttcttctagtagtgttggagctgttactgatttagatctattttga

SEQ ID NO: 294 - protein, 561 aa, Acaryochloris marin
MSDNRNSQVVTQGVQRAPNRAMLRAVGFGDDDFTKPIVGLANGFSTITPCNMGIDSLATRAEASIRTAGAMPQKFGTITISDGISMGTEGMKYSLVSREVIADSIETACMGQSMDGVLAIGGCDKNMPGAMLAMARMNIPAIFVYGGTIKPGHLNGEDLTVVSAFEAVGQHSAGRISEAELTAVEKHACPGAGSCGGMYTANTMSSAFEAMGMSLMYSSTMAAEDEEKAVSAEQSAAVLVEAIHKQILPRDILTRKAFENAIAVIMAVGGSTNAVLHLLAISRAAGDSLTLDDFETIRAQVPVICDLKPSGRYVATDLHKAGGIPLVMKMLLEHGLLHGDALTITGKTIAEQLADVPSEPSPDQDVIRPWDNPMYKQGHLAILRGNLATEGAVAKITGIKNPQITGPARVFESEEACLEAILAGKIQPNDVIVVRYEGPKGGPGMREMLAPTSAIIGAGLGDSVGLITDGRFSGGTYGMVVGHVAPEAAVGGTIALVQEGDQITIDAHARKLELHVSDQELKERKEKWEQPKPLYNKGVLAKYAKLVSSSSVGAVTDLDLF

SEQ ID NO: 295 - DNA, 1683 bp, Lyngbya sp.
atgtcagataactttagaagtcaagccatcacccaaggaaagaaacgcacaccgaaccgggcgatgctccgagcggtagggtttggggatgaggactttaataagcctattgtcggcattgctaatggttacagtaccattactccctgcaacattggattgaacgatttggcgcatcgtgctgaaacggcattaaaacaagccgacgctatgcctcaaatgtttgggacgattactgttagtgatggcattgccatgggaaccgaggggatgaaatattctctggtttcccgagaggtgatcgccgatgcgattgaaactgcttgtaatgggcagagtatggatggcgttttggcgattggcggttgtgataaaaatatgcctggggcgatgattgcgatcgcgaggatgaatattccggcaatttttgtgtatggcggtacgattaaaccggggaatttaaacggttgtgatttaacggttgtcagtgcgtttgaggctgtcggcgaatacagcgccgggaaacttgatgatgatcgcttactcgatattgaacgccttgcttgtccgggttcggggtcttgtgggggaatgtttacggcaaatactatgtcttcggcgtttgaagcgatggggatgagtttaatgtattcttccacaatggcttctgaagatgcggaaaaggctgatagtaccgaaaagtctgcgtttgtgttgcgtgaggcgattagtcaacggattttaccgaagcaaattctcacccgcaaggcgtttgaaaatgcgatcgctgtgattatggcggtgggcggttcgacaaactcggtattacacttgttggcgattgcttatgcagcagatgtggaactgacgattgatgattttgaaacaattcggggacgggttccggttttatgtgatcttaaacccagtgggcgatttgtcacgacggattttcacaaagcgggtggcgttccgctgattatgaaaatgcttctcgaacagggtttaattcatggtgatgctttaacgattaccgggaaaacggttgccgaacagttggctgatattccctctcaaccgtctgcggatcaagaggtgattcgcccctggaataatccgatgtacaagcaagggcatttagcgattttgaagggaaatctcgccacagaaggcagtgttgctaaaattacaggcgtgaaaaaaccgcaaatgactggccccgcacgggtatttgagtcggaagaacagtgtttagaggcgattttagcgggtaaaattcaagctggagatgttttggtggttcgctatgaaggccccaaaggtggccccggaatgcgagaaatgttggcgccgacttccgcaattattggggcaggcttaggggattctgtgggcttgattaccgatggacggttttcggggggaacttatggcttggttgtcggtcatgttgccccagaagctgccgttggtggtaatattgcgttggttcaagagggcgatagtattacgattgatgcttcacaacggttattgcaggtgaatatttctgatcaggtattggaacaacgccgtcaaaattggcaaccgcctcaacctcgttacacaaaaggtgttttagctaaatatgcgaagttagtgtcttcgagtagtgtgggggcggtgacggatttagactgttaa

SEQ ID NO: 296 - protein, 560 aa, Lyngbya sp.
MSDNFRSQAITQGKKRTPNRAMLRAVGFGDEDFNKPIVGIANGYSTITPCNIGLNDLAHRAETALKQADAMPQMFGTITVSDGIAMGTEGMKYSLVSREVIADAIETACNGQSMDGVLAIGGCDKNMPGAMIAIARMNIPAIFVYGGTIKPGNLNGCDLTVVSAFEAVGEYSAGKLDDDRLLDIERLACPGSGSCGGMFTANTMSSAFEAMGMSLMYSSTMASEDAEKADSTEKSAFVLREAISQRILPKQILTRKAFENAIAVIMAVGGSTNSVLHLLAIAYAADVELTIDDFETIRGRVPVLCDLKPSGRFVTTDFHKAGGVPLIMKMLLEQGLIHGDALTITGKTVAEQLADIPSQPSADQEVIRPWNNPMYKQGHLAILKGNLATEGSVAKITGVKKPQMTGPARVFESEEQCLEAILAGKIQAGDVLVVRYEGPKGGPGMREMLAPTSAIIGAGLGDSVGLITDGRFSGGTYGLVVGHVAPEAAVGGNIALVQEGDSITIDASQRLLQVNISDQVLEQRRQNWQPPQPRYTKGVLAKYAKLVSSSSVGAVTDLDC

SEQ ID NO: 297 - DNA, 1686 bp, Synechocystis sp.
atgtccaacaatcccagaagccaggtaattacccagggcacccaacggagtcccaaccgggccatgctccgggccgttggttttggcgatgatgactttacgaaacccattgtgggtattgccaacgggtacagcaccattaccccctgcaacatgggcattaatgatctggctctacgggccgaggccggcttacggacagcgggggccatgccccaattgtttggcactatcaccatcagtgacggtatttccatgggtacggaagggatgaaatattccctagtttcccgggaagtgattgctgattccatcgaaacagtatgcaatggccaacgcatggacggagttttggcgatcgggggctgtgataagaatatgccgggggcaatgattgccatggctcgcctcaatattccctctatctttgtttacggtggcactattaaacccggacattatgccggggaagatttaacagtggtcagtgcctttgaagcggtgggccagtacagcgctggcaaaattgatgaggaaaccctctacggcattgaacggaatgcctgtcctggggctggttcctgtggggggatgttcaccgccaacaccatgtcctccgcctttgaagctatggggatgagcttgccctattcttctaccatggccgcagtggatggggaaaaagccgacagcaccgaggagtccgccaaggttttggtggaagccatcaaaaaacagattttgcccagtcaaattctgacccggaaagcttttgaaaatgccattgccgtgattatggccgtggggggctccactaatgcagtgctccatctgctggcgatcgccaacaccattggggtgcccctaagcttggacgattttgaaaccattcgccacaaagtacctgtactgtgcgacctcaaaccttccggcaaatacgtcaccactaatctccacgccgccggtggcattccccaggtgatgaaaatattgctggtcaatggcattctccacggtgacgctttaacgattacaggacagaccattgctgaagttttagccgatattcctgaccaaccccctgccggccaggacgtaatccattcctgggatgaccctgtttatcaagaaggtcacctggcagtgctcaaaggtaacctggccaccgaaggcagtgtggctaaaatcagcggtgttaaaaagccggtgatcactggtcccgccaaagtatttgaatctgaagaagattgcctagaagcgattctagccggcaaaattcaagcaggagatgtggtggtcgtgcgctatgaagggcccaaaggtggccccggtatgcgggaaatgctagcccccacttctgccatcattggggcagggttgggagactccgttggcctaatcaccgatggccgcttttctggtggtacctatggcttagtggtgggtcacgttgcccccgaagcttatgtgggaggggcgatcgccttggtgcaagagggggatcaaatcaccatcgatgctggcaagcggttactgcaactcaacatcagtgaagaggaattggcccaacggcgggcccaatggactcctcctcagccccgctatccccgggggattttagccaagtatgccaagttagtttcctccagcagccttggtgcagtgactgatatagacttgttctaa

SEQ ID NO: 298 - protein, 561 aa, Synechocystis sp.
MSNNPRSQVITQGTQRSPNRAMLRAVGFGDDDFTKPIVGIANGYSTITPCNMGINDLALRAEAGLRTAGAMPQLFGTITISDGISMGTEGMKYSLVSREVIADSIETVCNGQRMDGVLAIGGCDKNMPGAMIAMARLNIPSIFVYGGTIKPGHYAGEDLTVVSAFEAVGQYSAGKIDEETLYGIERNACPGAGSCGGMFTANTMSSAFEAMGMSLPYSSTMAAVDGEKADSTEESAKVLVEAIKKQILPSQILTRKAFENAIAVIMAVGGSTNAVLHLLAIANTIGVPLSLDDFETIRHKVPVLCDLKPSGKYVTTNLHAAGGIPQVMKILLVNGILHGDALTITGQTIAEVLADIPDQPPAGQDVIHSWDDPVYQEGHLAVLKGNLATEGSVAKISGVKKPVITGPAKVFESEEDCLEAILAGKIQAGDVVVVRYEGPKGGPGMREMLAPTSAIIGAGLGDSVGLITDGRFSGGTYGLVVGHVAPEAYVGGAIALVQEGDQITIDAGKRLLQLNISEEELAQRRAQWTPPQPRYPRGILAKYAKLVSSSSLGAVTDIDLF

SEQ ID NO: 299 - DNA, 1686 bp, Cyanothece sp.
atgtctgagaatgcaagaagtcgcctcattaccgagggaagtcaacgaacccctaaccgtgccatgttgcgtgctgtgggcttcggagatgatgattttaataagcctattgttggggtagctaatggcttcagtaccataaccccttgtaacatggggattaatgacctagctaaacgtgctgaagcaggaattaaaaccgctggtgggatgcctcagatattcggtaccattaccatcagtgatggcatttctatgggaaccgaaggcatgaaatattccctcgtctcacgggatgttattgccgactctatcgaaaccgtttgtaatggtcaaagcatggatggagtgatcgctattggtggatgcgacaagaatatgccaggggcaatgatagccatggcaagaatgaatatacctgcaatctttgtctatggaggaaccattaaacccggccattacaacggggaagatttaacagtagtcagtgcctttgaagcggtcggccaacatagtgcaggtaagatagatgatagcacattattggctattgaacgtaatgcttgccccggtgccggttcctgtgggggaatgttcaccgcaaataccatgtcttcagcgtttgaagtgatgggaatgagtttaccttattcttctacgatggcagcagaagatgcagaaaaagcagacagtacagaaaagtcagcttttgctttagttaatgccattcgtaaccagattttacccagtcacattttaacccgaaaagcctttgaaaatgccatttctgtaatcatggcggtgggaggttctacgaatgctgtattacaccttttagcgatcgctaataccatcggtgttgacctaactttagacgattttgaaaccattcgtcaacgggttcctgtactctgtgatttaaaaccatcgggacgctatgtaacggttaatttgcatgaagcgggtggcattcctcaagtgatgaaactattattaaatcatggattattacatggggatgcgttaacgatttccggtcaaactatagcagaaattttagccgatgtaccggatgaacctccagcgaatcaagatgttattcggacttgggataaccctgtttataaagagggacatttagccattttaaaaggtaatttagcctctgagggtgcagttgccaaaattagtggggtaaagaatcccaaaataacaggtccggcgcgagtttttgagtcggaagaggaatgtttagaggcaattttagcaggaaaaattaacgctggtgatgtcattattgtccgttatgaaggtcctagaggaggcccaggaatgcgagaaatgttagcaccaacttctgcaattattggggctggtttaggtgattccgtgggcttaattaccgatggccggttttctgggggaacctatggtttagtggtgggtcatgttgccccagaagcttacgtagggggtactattggcttagtaaaagaaggggatagtattaccattgatgctaaagaaaaactccttcaagtcaatgtttctgaagaagaattaaaccaacgtcgggctaattggaaagctcccgaacctcgttataaaagaggggtattaggtaagtatgccaagttagtttcttctagtagtttaggggcagttactgacgtgaatttgttttaa

SEQ ID NO: 300 - protein, 561 aa, Cyanothece sp.
MSENARSRLITEGSQRTPNRAMLRAVGFGDDDFNKPIVGVANGFSTITPCNMGINDLAKRAEAGIKTAGGMPQIFGTITISDGISMGTEGMKYSLVSRDVIADSIETVCNGQSMDGVIAIGGCDKNMPGAMIAMARMNIPAIFVYGGTIKPGHYNGEDLTVVSAFEAVGQHSAGKIDDSTLLAIERNACPGAGSCGGMFTANTMSSAFEVMGMSLPYSSTMAAEDAEKADSTEKSAFALVNAIRNQILPSHILTRKAFENAISVIMAVGGSTNAVLHLLAIANTIGVDLTLDDFETIRQRVPVLCDLKPSGRYVTVNLHEAGGIPQVMKLLLNHGLLHGDALTISGQTIAEILADVPDEPPANQDVIRTWDNPVYKEGHLAILKGNLASEGAVAKISGVKNPKITGPARVFESEEECLEAILAGKINAGDVIIVRYEGPRGGPGMREMLAPTSAIIGAGLGDSVGLITDGRFSGGTYGLVVGHVAPEAYVGGTIGLVKEGDSITIDAKEKLLQVNVSEEELNQRRANWKAPEPRYKRGVLGKYAKLVSSSSLGAVTDVNLF

SEQ ID NO: 301 - DNA, 1683 bp, Thermosynechococcus elongatus
atggcagaaaattggcgcagtcgcatcatcacagaaggcattcaacgcacccccaaccgagccatgctgcgagccgtgggttttggtgacgaggattttaacaagcccattgtgggggtggccagtgcccacagcacaattacgccctgcaacatggggattgctgcccttgccagtcgcgccgaagcaggaattcgggccgcgggagggatgccgcaattgtttggcaccattacggtcagcgatggtatttccatgggcactgaagggatgaaatactctttggtctcgcgggatgtgattgctgattcgattgagactgtctgtaatgcccagagtatggatggggtgctggcgatcggtggctgtgacaagaatatgcctggcgccatgattgccatggcacggatgaacattccagccatttttgtctatgggggtacgattaagcccggtcattggcaggggcaagaccttacggttgtcagcgcctttgaggccgtaggtcagtttagtgccggcaaaatggatgaggcaacgctccatgccattgaacaccatgcctgtccgggggcgggctcctgtggcgggatgttcacagccaatacgatgtcctcggcctttgaggccatgggcatgagtttaatgtattcctcaacgatgacggcggaagatgccgaaaaagctgacagcactgagttggcgggcaaggtgctggtggaggcaatccgcaaaaatattcgcccccgtgacattattacccgcaaatccattgaaaatgccatcagtgtgattatggctgtggggggatccacaaatgccgtgctgcattttctggcgatcgcccacagtgccgaggttcccttgaccattgatgattttgaaacgattcgccagcgggtgcccgttctctgcgacctcaagccctcgggtaaatacgtcactgcggatctacatcgggcagggggcattccccaagtcatgaaaatgctcctcaatgccggattgctccacggggattgcctaacgattactggagaaaccattgccgagcggctgcggcatgtgcccgatacccccgaccccaaccaagatgtgattcgtccttttgatcaacccttgtatgccacgggtcacctggctattctcaagggcaatctagccagcgaaggtgctgtagccaaaatctccggggtgaaaaatccccaaattaccgggcctgcccgcgtctttgactccgaggaagactgccttgacgccattctggcgggcaagatcaaccccggcgatgtcattgtcattcgctatgaaggccccgtcggcggtccggggatgcgggaaatgctggctcccacctctgccattattggtgcgggtttaggggatagtgttggcctcattaccgatggtcgcttttccggaggcacctatggcatggtcgtcggtcatgtggcgccggaagcggcagttggtgggacgatcgcccttgtgcaggagggagattcgattaccattgacgcccatcggcggctcctacaactgaatgtcagtgaggaagaactggcggcgcggcgggctaaatggcagccccctgcccctcgctacacccgtggtgtcttggctaaatatgccaaactagtgtcctctagtagtctgggagcggtgacggatcgctttgtctag

SEQ ID NO: 302 - protein, 560 aa, Thermosynechococcus elongatus
MAENWRSRIITEGIQRTPNRAMLRAVGFGDEDFNKPIVGVASAHSTITPCNMGIAALASRAEAGIRAAGGMPQLFGTITVSDGISMGTEGMKYSLVSRDVIADSIETVCNAQSMDGVLAIGGCDKNMPGAMIAMARMNIPAIFVYGGTIKPGHWQGQDLTVVSAFEAVGQFSAGKMDEATLHAIEHHACPGAGSCGGMFTANTMSSAFEAMGMSLMYSSTMTAEDAEKADSTELAGKVLVEAIRKNIRPRDIITRKSIENAISVIMAVGGSTNAVLHFLAIAHSAEVPLTIDDFETIRQRVPVLCDLKPSGKYVTADLHRAGGIPQVMKMLLNAGLLHGDCLTITGETIAERLRHVPDTPDPNQDVIRPFDQPLYATGHLAILKGNLASEGAVAKISGVKNPQITGPARVFDSEEDCLDAILAGKINPGDVIVIRYEGPVGGPGMREMLAPTSAIIGAGLGDSVGLITDGRFSGGTYGMVVGHVAPEAAVGGTIALVQEGDSITIDAHRRLLQLNVSEEELAARRAKWQPPAPRYTRGVLAKYAKLVSSSSLGAVTDRFV

SEQ ID NO: 303 - DNA, 1698 bp, Synechococcus sp.
atggccaattcccctttcccgctgcgcagccaagtggttacccagggagtacagcgctcccccaaccgcgccatgctcagggccgtaggctttcgcgacgaagacttcggcaagcccattgtcggcattgccaacgcccacagcaccctcaccccctgcaacatggggatccaaactctggcggagcgggcggaggcggctttgagaacggcgggctgtatgccccaggtgttcggcaccatcaccattagcgacggcatctcgatgggcacggaggggatgaaatactccctggtgtcgcgggaagtgattgccgattccatcgagacggtggtcaacggccagagcatggatggcctcttggccattggcggctgcgacaagaacatgccgggggcgatgatcgccatggcccgcctcaatgtgccctccatcttcgtctacggcggcaccatcaagccgggtcactacaatggccgcgacctcaccatcgtcagcgcctttgaagcggtgggggagttcagtgccgggcgcatctccgaggaagagctgctggcggtggagcgccatgcctgtcccggtgccggatcctgcggcggcatgtacacggccaacaccatgtccagcgcgtttgaggctatggggatgagtctgccctactcctccaccatggctgcagaagacgaagagaaagccgaaagtgccgcccaatcggccaaggtcttggcagaggccatcaaagccaacatccgcccccgcgacatcatcacccgtaaaagcattgaaaatgccatctcggtgatcatggccgtagggggatccaccaacgccgtgctccactttctggccattgcccatgcggcagaagtgcccctgacgctagatgatttcgagaccattcgtgctcgcgtgcctgtcctctgcgatctcaagccttcagggcggtttgtggccaccgacctgcaccgggccggtgggatcccccaggtgatgaaaatgctgctcaaccacggcctgctgcacggggactgcctcaccatctccggccagaccatcgtcgaagtcctgcgggatgtgccggacgagcctagcccggatcaggaggtgatccgcccttggcacagccccctgtatccccaagggcatctggccatcctcaaggggaatctggctcccgaaggagcagtagccaagattaccggcgtcaagaacccgcaaattaccgggccggcgcgggtcttcgattcagaggagtcctgcctgcaggccatcctctccggccagatccgagcaggggatgtggtggtgatccgctacgaaggccccaaaggtggccccggcatgcgggagatgctctcgcccacttcggccatcatcggcgccggcttgggggatagcgttggcctgatcaccgatggccgcttctccggcggcacctacggcatggtagtgggccatgtggctcccgaagcctatgtggggggcacgattgccctggtggaggaaggggatctcatcaccattgatgccccggctcgccagttgcacttgcatgtgagcgaagaagagctggcccgccgccgcgcccgctggtctcctcctgagcctcgctacaaacggggcaccctagccaagtacgccaagctggtctccagcagcagcctgggggcagtgacggatttaaacctgtgggattaa

SEQ ID NO: 304 - protein, 565 aa, Synechococcus sp.
MANSPFPLRSQVVTQGVQRSPNRAMLRAVGFRDEDFGKPIVGIANAHSTLTPCNMGIQTLAERAEAALRTAGCMPQVFGTITISDGISMGTEGMKYSLVSREVIADSIETVVNGQSMDGLLAIGGCDKNMPGAMIAMARLNVPSIFVYGGTIKPGHYNGRDLTIVSAFEAVGEFSAGRISEEELLAVERHACPGAGSCGGMYTANTMSSAFEAMGMSLPYSSTMAAEDEEKAESAAQSAKVLAEAIKANIRPRDIITRKSIENAISVIMAVGGSTNAVLHFLAIAHAAEVPLTLDDFETIRARVPVLCDLKPSGRFVATDLHRAGGIPQVMKMLLNHGLLHGDCLTISGQTIVEVLRDVPDEPSPDQEVIRPWHSPLYPQGHLAILKGNLAPEGAVAKITGVKNPQITGPARVFDSEESCLQAILSGQIRAGDVVVIRYEGPKGGPGMREMLSPTSAIIGAGLGDSVGLITDGRFSGGTYGMVVGHVAPEAYVGGTIALVEEGDLITIDAPARQLHLHVSEEELARRRARWSPPEPRYKRGTLAKYAKLVSSSSLGAVTDLNLWD

SEQ ID NO: 305 - DNA, 1683 bp, Gloeobacter violaceus
atgtccggcaatctgcgcagccgcatcgtcacccagggggtgcagcgctcccccaaccgcgccatgctgcgggcggtgggttttggcgacggtgatttcgagcggcccatcgtgggggtggccaacggcttcagcacgattaccccctgcaatctgggcctgggagctttggcggagcgggcggaggcggcgttgcgcgccggcggggcgatgccccaactattcggaacgatcacgatcagcgacggcatctcgatgggtaccgaggggatgaagtactcgctggtgtcccgcgaggtgatcgccgacagcatcgagacggtctgcaacggtcagagcctggacggggtgctcgctatcggcggctgcgacaagaacatgccgggtgcgatgatcgccattgccagactcaatatcccggcggtcttcgtctacggcggcacgatcaaacccggccgctaccaggatcaggacctcacggtcgtgagcgccttcgaagcggtgggccagtacagcgccggcaaaattgaccagacgaccctcgtcgaaatcgagcggcgcgcctgcccgggggcgggctcctgcggcggcatgtacaccgccaatacgatgagttcggccttcgaggcgatgggcatgagcttggtgtactcctcgacgatggccgccgaggatcccgaaaaagcggacagcaccgccctgtcggccaaggtgctggttgaagcgatccaagcgcaaatcctgccgagcgccatcctgacgcgaaaagctttcgagaacgccatcgctgtgatcatggccatcggcggctcgaccaacgccgtgctgcacctgcttgccatcgcccacagcgcccgggtgccactcgcactggatgacttcgagtgcatccgcgcgcgggtgccggtgctgtgcgatctcaagcccagcggtcgctttgtcgccaccgatctgcacagagccgggggtattccccaggtgatgaaaatgttgctcgtgcgcgggctcctccacggcgacgccctcacggtaaccggccagacggtcgccgaggtgctgcgcgacgtacccacagaaccgcgcaccgaccaggaggtgatccgtccctgggaccggcctctctacagttcggggcacctggccattttgcgcggcaacctggcgagcgaaggggcggtcgccaagattaccggcgtcaaaaagccccagatcactggtcctgcccgcgtcttcgactccgaagaaagctgcatggaagcaattctggcgggcgccatccagccgggcgatgtgatcgtcattcgctacgaaggccccaagggcggtcccggcatgcgggagatgctctcgcccacttcggccatcatcggcgcgggtctgggcgatgcggtgggactgatcaccgacggccgcttctcggggggcacctacggcatggtcgtgggccacgtcgccccggaagccttcgtgggcggcaccatcgccctggtcgaagcaggagatctgatcaccatcgacgccccggcgcgcaagatcgagctattggtgaccacagacgaactggagcgccgacgcgccgcctggcggccgcctgccccccgttacatccgcggggtgctcgccaagtacgcccgtcaggtgaacagcagcagcctcggggcggtcaccgacgcctttatttga

SEQ ID NO: 306 - protein, 560 aa, Gloeobacter violaceus
MSGNLRSRIVTQGVQRSPNRAMLRAVGFGDGDFERPIVGVANGFSTITPCNLGLGALAERAEAALRAGGAMPQLFGTITISDGISMGTEGMKYSLVSREVIADSIETVCNGQSLDGVLAIGGCDKNMPGAMIAIARLNIPAVFVYGGTIKPGRYQDQDLTVVSAFEAVGQYSAGKIDQTTLVEIERRACPGAGSCGGMYTANTMSSAFEAMGMSLVYSSTMAAEDPEKADSTALSAKVLVEAIQAQILPSAILTRKAFENAIAVIMAIGGSTNAVLHLLAIAHSARVPLALDDFECIRARVPVLCDLKPSGRFVATDLHRAGGIPQVMKMLLVRGLLHGDALTVTGQTVAEVLRDVPTEPRTDQEVIRPWDRPLYSSGHLAILRGNLASEGAVAKITGVKKPQITGPARVFDSEESCMEAILAGAIQPGDVIVIRYEGPKGGPGMREMLSPTSAIIGAGLGDAVGLITDGRFSGGTYGMVVGHVAPEAFVGGTIALVEAGDLITIDAPARKIELLVTTDELERRRAAWRPPAPRYIRGVLAKYARQVNSSSLGAVTDAFI

SEQ ID NO: 307 - DNA, 1674 bp, Nitrosomonas eutropha
atgccagacaatcgacgcagccaggccatcactaaaggtgcgaaacgtgctcccaatcgcgccatgttacgtgcagttggattcggtgacggagatttcgataagcccattgtcggcattgccaacggcttttccaccatcacgccttgcaacatggggctggatacgcttgccaaatgtgcggaacatgcattgaaaaatgccggtgccatgccgcaaatgttcggcacgattacggtatcggatggtatctccatgggcaccgaaggcatgaaatactcactggtatcacgcgaggtaatcgctgattccattgaaacctgcgtgcaggcggaaagcatggatggcgtcattgccattggcgggtgtgacaaaaacatgcctggtgccctaatcgcgctggctagactgaacgtgccatccatttttgtctatggcggcaccatcaagcccggtcactaccagggtcgcgatctgacaatcgtcagtgcgtttgaagcggttgggcaacatagcgcacacaagattgatgatcaggaactgctggaagttgaacgccatgcctgtcccggcgcaggttcgtgcggcggcatgtacaccgccaacaccatgtcctctgcgattgaggcgatgggcatgagtctgccccattcctccactatggctgcggaagatgaggaaaagcggatcagcgccacccgctctgccgaggtgctggtggaagcaatcaaaaaacagattctgccgcgcagcctgattacccgcaagtcactcgaaaatgcagtaacggtagtcatggccgtaggcggctcgaccaatgctgtgctgcatctgctggccatcgcccacgcagcagaagtagattttcatattgacgatttcgaagcgattcgtgcccgtgtgccggtgttgtgtgacctgaaaccttccgggcgctacgtcgccactgatctgcacagagcaggcggcattccacaagtgatgaaaatgctgctcgtgcacggtctgctgcatggtgactgtctgaccatcagcggacaaactatcgctgaagtactgaaagatattcctgaacaaccgcgcgcggatcaaaacgtcatccgcacctgggacaacccggtgtatgaacaaggtcatctggcgatcctgaagggtaatctttcgccggaaggtgcggtggccaagatttccggtgtaaaaaaccccaatattaccgggcccgccagagtgtttgaatccgaagaaacctgtatgactgccattctcgatcgcaaaatcaagccgggtgatgttgtcgttattcgctacgaggggccacgcggcggtcccggcatgcgtgaaatgctctcccctacttcggcgctaatcggtgaaggattgggtgattcggtcggattgattaccgatggccgtttttccggcggcacctacggcatggtcgtaggccatgtagcaccggaagcatacgccgggggagtgatcgctctggtggaagaaggagattcaatcacaatcgatgcgcatcgccgcctgttacaactgaatgtttcagaaacagaattggaacgccgccgggctgcctggcagccgcctgcgccgcgctacacacgcggtgtactggcaaaatatgccaaactggtatcaaccgccagtcgtggtgcggttactgattaa

SEQ ID NO: 308 - protein, 557 aa, Nitrosomonas eutropha
MPDNRRSQAITKGAKRAPNRAMLRAVGFGDGDFDKPIVGIANGFSTITPCNMGLDTLAKCAEHALKNAGAMPQMFGTITVSDGISMGTEGMKYSLVSREVIADSIETCVQAESMDGVIAIGGCDKNMPGALIALARLNVPSIFVYGGTIKPGHYQGRDLTIVSAFEAVGQHSAHKIDDQELLEVERHACPGAGSCGGMYTANTMSSAIEAMGMSLPHSSTMAAEDEEKRISATRSAEVLVEAIKKQILPRSLITRKSLENAVTVVMAVGGSTNAVLHLLAIAHAAEVDFHIDDFEAIRARVPVLCDLKPSGRYVATDLHRAGGIPQVMKMLLVHGLLHGDCLTISGQTIAEVLKDIPEQPRADQNVIRTWDNPVYEQGHLAILKGNLSPEGAVAKISGVKNPNITGPARVFESEETCMTAILDRKIKPGDVVVIRYEGPRGGPGMREMLSPTSALIGEGLGDSVGLITDGRFSGGTYGMVVGHVAPEAYAGGVIALVEEGDSITIDAHRRLLQLNVSETELERRRAAWQPPAPRYTRGVLAKYAKLVSTASRGAVTD

SEQ ID NO: 309 - DNA, 1674 bp, Nitrosomonas europaea
atgccagataatcgacgcagccaaaccattacccaaggtgcacaacgcacccccaaccgcgccatgttacgcgcagtcggtttcggtgacggagacttcgataaacctatcgtcggggttgccaacggtttttccaccatcacaccctgcaacatggggctggatacccttgccaaatgcgccgaacatgcgctgaaaaccgccggtgccatgccgcagatgtttggcaccatcaccgtatccgacgggatctccatgggtaccgaaggcatgaagtattctctggtttcgcgcgaagtgatcgccgattcgatcgaaacctgcgtacaggcggaaagtatggatggcgtcatcgccatcggtggttgcgataaaaacatgcctggcgccatgatcgcgctggccagactgaacgtaccgtccatcttcgtctatggcggtaccatcaaacctggccattaccagggccgtgatctgaccatcgtaagcgctttcgaagctgtcggacagcataccgcgcacaagatagacgatcatgaactgctggaagtcgaacgccatgcctgtcccggcgccggttcgtgcggtggtatgtacacagccaacaccatgtcatctgccatcgaggcaatgggaatgagcctgccttactcttccaccatggcagcagaagatgaggaaaaacggatcagcgccatacgctccgccgaagtactggtggacgcggtcaaaaagcagattctgccgcgcagcctgatcacccgcaaatccatcgaaaatgcggtatctgtcgtcatggcggtgggaggttcgaccaatgccgtgctgcacctgctggccatcgcccatgcagccgaagtggaattcagcatcgatgatttcgaagccattcgtgcacgcgtaccggtattgtgcgatctgaaaccttccggacgctatgtagccacggatctgcacaaagcgggcggtattccgcaagtgatgaaaatgttgctggtacacgacctgctgcacggcgactgtctgaccatcagcggacaaaccatcgcggaagtgctgaaagacattcccgaacagccgcgtgccgatcaggatgtgattcaaccctgggacaatccggtatatgaacaggggcacctggcgatcctgaaaggtaatctttcatcagaaggtgcggttgccaagatttccggcatcaaaaatcccagtattaccggtcccgccagagtgttcgattctgaagaaacctgcatggctgccattcttgaacgcaaaatccagccaggtgatgtggtggtcatccgctacgaaggcccacagggcggacccggcatgcgcgaaatgctttctcccacttcagcactgatcggtgaagggctgggtgattcggtcgggttgattaccgatgggcgtttctccggtggtacctacggaatggtggtgggccatgtggcaccggaagcattcgccggcggaacgatcgccctggtacaagagggagattcgattacgatcgatgcacaccgtcgcctgctgcaactgaatgttcctgaagccgagctggaacgccgccgggcagcctggcatccacctgcaccacgctacacacgcggcgtactggcgaaatacgccaagctggtatccactgccagccgtggtgcagtcaccgattaa

SEQ ID NO: 310 - protein, 557 aa, Nitrosomonas europaea
MPDNRRSQTITQGAQRTPNRAMLRAVGFGDGDFDKPIVGVANGFSTITPCNMGLDTLAKCAEHALKTAGAMPQMFGTITVSDGISMGTEGMKYSLVSREVIADSIETCVQAESMDGVIAIGGCDKNMPGAMIALARLNVPSIFVYGGTIKPGHYQGRDLTIVSAFEAVGQHTAHKIDDHELLEVERHACPGAGSCGGMYTANTMSSAIEAMGMSLPYSSTMAAEDEEKRISAIRSAEVLVDAVKKQILPRSLITRKSIENAVSVVMAVGGSTNAVLHLLAIAHAAEVEFSIDDFEAIRARVPVLCDLKPSGRYVATDLHKAGGIPQVMKMLLVHDLLHGDCLTISGQTIAEVLKDIPEQPRADQDVIQPWDNPVYEQGHLAILKGNLSSEGAVAKISGIKNPSITGPARVFDSEETCMAAILERKIQPGDVVVIRYEGPQGGPGMREMLSPTSALIGEGLGDSVGLITDGRFSGGTYGMVVGHVAPEAFAGGTIALVQEGDSITIDAHRRLLQLNVPEAELERRRAAWHPPAPRYTRGVLAKYAKLVSTASRGAVTD

SEQ ID NO: 311 - DNA, 1674 bp, Nitrosospira multiformis
atgtcagataaccagcgcagccgggcaatcacccagggggcggaacgtacccccaaccgcgcgatgctgcgggccgtaggtttcagcgacaacgatttcgacaaaccaatcgtcggcgtggccaatggcttttccaccatcacaccctgcaacaagggattgaacgaactggcgctggctgccgagcaggcattgaaacaggcggctgcgatgccccagatgttcggtaccatcaccgtttccgatggcatctccatgggaacggagggcatgaagtattcactggtatcccgcgaagtcattgccgactcgatcgaaacggcggtgcaggccgaaagcatggatggcgtgatcgccatcgggggctgtgacaagaacatgccaggagcaatgatcgccattgcgcgcatgaatgttcccgcaatttttgtttatggcggaacgattaaaccgggccactataaaggaaaggatctcactattgtcagcgcattcgaagccgtcggacaatatacctcccacaagatagacgcgaaagaactgctcgaagtggagcgccacgcctgtccgggagccggctcctgcggaggcatgttcactgccaatacgatgtcgtccgctttcgaagcgatgggcatgagtctcccctattcttccacgatggccgcggaggatggcgagaagctaaccagcgcggcgcgctccgcggaagtgctcgtggatgccatcaggaaacagattcgcccgcgcgacatcattacccgcaagtccattgaaaacgcgatcgcggtgatcatggccgtgggtggttccaccaatgctgttttgcacttcctcgccattgcccatgcggccgaagtgacactcaccatcgatgattttgaacgcatgcgcggcaaagtgccggtactgtgcgatctcaaaccttcgggacggtacgttgccaccgacctgcacaaggcagggggcattccccaggtcatgaaaatgctgctcgaccacggcctgttgcatggcgactgcatcaccatcagcggacagaccattgccgagatattgaaggatgtgccgtcagagcctcgcgaagatcaggatgtcattcgccagtgggacaacccgttgtacgtccagggccacctcgccatactcaagggcaatctcgccccagaagggtgcgtggcgaaaatcaccggggtgaaatccccaaaaattaccggaccggcacgcgtattcgattcggaagaagcctgcatggcagctatccttgcgcgggagatccagcccggcgacgtggtggtgatacgctatgagggacccaagggcggccccggcatgcgggaaatgctgtctcccacttccgcgcttattggcgagggactcggagattcggtgggcctgatcaccgatggacgattctccgggggcacctatggaatggtggttggacacgtggcgccggaggcgttcgtaggcgggaccattgcgctggtgcgagaaggcgattcgattaccatagacgccgagcaacggctgctgcagctcaacattcccggagatgagctggctcggcgccgggctgaatggcaaccgccccatccgcgctacacccggggagtgctcgctaaatattcgaagctcgtctcgagtgccagccgcggcgcaatcaccgactag

SEQ ID NO: 312 - protein, 557 aa, Nitrosospira multiformis
MSDNQRSRAITQGAERTPNRAMLRAVGFSDNDFDKPIVGVANGFSTITPCNKGLNELALAAEQALKQAAAMPQMFGTITVSDGISMGTEGMKYSLVSREVIADSIETAVQAESMDGVIAIGGCDKNMPGAMIAIARMNVPAIFVYGGTIKPGHYKGKDLTIVSAFEAVGQYTSHKIDAKELLEVERHACPGAGSCGGMFTANTMSSAFEAMGMSLPYSSTMAAEDGEKLTSAARSAEVLVDAIRKQIRPRDIITRKSIENAIAVIMAVGGSTNAVLHFLAIAHAAEVTLTIDDFERMRGKVPVLCDLKPSGRYVATDLHKAGGIPQVMKMLLDHGLLHGDCITISGQTIAEILKDVPSEPREDQDVIRQWDNPLYVQGHLAILKGNLAPEGCVAKITGVKSPKITGPARVFDSEEACMAAILAREIQPGDVVVIRYEGPKGGPGMREMLSPTSALIGEGLGDSVGLITDGRFSGGTYGMVVGHVAPEAFVGGTIALVREGDSITIDAEQRLLQLNIPGDELARRRAEWQPPHPRYTRGVLAKYSKLVSSASRGAITD

SEQ ID NO: 313 - DNA, 1695 bp, Chloroflexus aggregans
atgagcgataatcgccgtagtcgtatgattaccgaaggcccacagcgttcacccaatcgggcaatgctgcgcgcggtcgggtttggcgacaacgattttacgaagccgatcgtgggagtggctaacggtcacagtacgctgacaccgtgcaacgccggcttaggggcgttggcagcgcgggcggaagccgctattcgtgccgcaggaggtatgccgcagatcttcggcacgatcacggtcagcgatggtatctcgatggggactgaagggatgaagtattctttggtcagccgcgaggtgattgccgattcgattgagacggtcgtcaacgcacagcggatggacggaatccttgcggtgggtggctgcgataagaacatgcccggcgccttaattgccatggcccggctcgacattccggccatctttgtctatggtggtactatcaaacccggtcattacaaaggccgtgacttgaccatcgtcagcgtgtttgaggcagttggcgaatacagtgccggtcggatcgacgaacacgagttgctcgaaatcgagcgtcacgcatgccccggcgtcggttcgtgtggtggtatgtacactgccaatacgatgtcgtcggcaattgaagcgctgggcttgagtttacccggctcttcaaccatggctgccgaagacgaggaaaaggcgatcagcgcagctcgttccggcgaggtgttagttgaggccatccgcgccaatcgcacagcgcgccagatgttgacccgcaagtcgtttgagaatgcgattgcagtagtgatggcgttaggtggctcgaccaacgccgttttgcatctgctggcgattgcctatgctgccaacgtaccgttgaccatcgatgattttgagacgatccgccagcgggtaccggtgctctgcgatctcaagccatcgggccgctatgtggcgaccgatctccaccgtgtcggtggtgtaccgcaggtgatgaagatgttgttgaatgccggcttactccacggtgattgtatgacgattaccggacagacaatcgctgaggtgctggccgatgtacccgacgagccgccggccgatcaagatgtcatccgcccctttcataaacccctctatccgcaaggacatttggccatcctccgtggtaatctggccgaagaaggctgcgttgcgaagattaccggtattaagcagcgctcgattaccggaccggcccgtgttttcgatgccgaagaggaatgtctcgaagcgattttgagtggcaagattaagccgggcgatgtcgtggtgatccggtacgaagggccgaagggtggtcccggtatgcgtgaaatgctcgctccgacatcggcgattatcggtgccggtttgggcgatagcgttggcctgattaccgacggacgcttctctggtggtacgtatggcttggtggtcggtcatgttgcccctgaagcggcggttggtggcaccattgccctggtcgaagagggtgatagtatcacgattgacgccgatgcccgtctcttgcagctcaatgtctcggacgaagagttggcacgacgccgtgctgcgtggcaaccccgtccgccacgctatacccgtggtgtattggcgaagtatgccaggctggtgtcgtcggctagccttggtgcagtgaccgaccgcttcgatggcgagtcggcgtaa

SEQ ID NO: 314 - protein, 564 aa, Chloroflexus aggregans
MSDNRRSRMITEGPQRSPNRAMLRAVGFGDNDFTKPIVGVANGHSTLTPCNAGLGALAARAEAAIRAAGGMPQIFGTITVSDGISMGTEGMKYSLVSREVIADSIETVVNAQRMDGILAVGGCDKNMPGALIAMARLDIPAIFVYGGTIKPGHYKGRDLTIVSVFEAVGEYSAGRIDEHELLEIERHACPGVGSCGGMYTANTMSSAIEALGLSLPGSSTMAAEDEEKAISAARSGEVLVEAIRANRTARQMLTRKSFENAIAVVMALGGSTNAVLHLLAIAYAANVPLTIDDFETIRQRVPVLCDLKPSGRYVATDLHRVGGVPQVMKMLLNAGLLHGDCMTITGQTIAEVLADVPDEPPADQDVIRPFHKPLYPQGHLAILRGNLAEEGCVAKITGIKQRSITGPARVFDAEEECLEAILSGKIKPGDVVVIRYEGPKGGPGMREMLAPTSAIIGAGLGDSVGLITDGRFSGGTYGLVVGHVAPEAAVGGTIALVEEGDSITIDADARLLQLNVSDEELARRRAAWQPRPPRYTRGVLAKYARLVSSASLGAVTDRFDGESA

SEQ ID NO: 315 - DNA, 1674 bp, Leptospirillum sp.
atgaaaaagccatttcgaagccggaccatcacccagggagtggaaagatctcccaacagggccatgctccgggccgtcgggttccaggatggggattttgaaaaaccgattatcggagtggcgaatggctacagcaccattacaccctgcaacatgggcctgaacagtctggctcttcgtgccgaggacgccattcgccagagaggagccatgccccagatgttcggaaccatcacggtttcggacggaatatcgatgggaacggaaggaatgaagttttccctggtgtcccgggaagtcatcgccgactccatcgaaacggcggtcagcgcccaaagcatggacggcgtgatcgccatcggggggtgcgacaagaacatgccgggagccctgatcgccatggggcgcatgaacatcccctccatttttgtttatggaggaaccatcaagcccggccactgggaaggtcaggacctgacggtcgtgagctcgttcgaagcggtcggggcctactcggcaggcaagatggacgaggcaaccctgaccgaaatcgagcgtcatgcctgtccgggagccggatcctgtggcggcatgttcactgccaataccatgtcgtcggcgatcgaagccatggggatgagtttgccctattcctccaccatggcagcggaagaccttgaaaaagccgaaagcgcagccgaatccgcaagagttcttgtccaggcggttctgaacgacctgcgtcctcgacagatcctgaccagaaaggcctttgaaaacgccattgcagtcctgatggccgttggaggctcgacgaacgcggttcttcacctcctcgcgatcgcccgctccgtcgacgtccccctttccatagacgactttgaacacattcgacgaaaggtccctgtcctttgcaacctcaagccctccggggcctatgtcgccacacagcttcacgctgtcgggggcattcccctcgtcatgcgcatgctgctggacaacggactccttcatggcgacgcgctgaccattacagggaagacgatttccgagacgctccgggacgttccttcccgtcccccggccggacaggatgtcgtgctcccctttgacaaacccgtttaccgggagggccaccttgcgatcctgaagggaaatctcgccccggaaggatcggtcgcaaagatctcgggcatcaaacaccgttccattaccggcccggcccgggtcttcgactccgaagaacgctgcatggcagccatcctggcccgggaaattcgtcccggagacatcgtcgtgatccggtacgaaggccccaaaggcggtcccggaatgcgggaaatgctggccccgacctccgccctgatcggagaaggtctcggggactcggtcggcctgattacagatggacgtttttccgggggcacatacggcatggtggtgggtcacgtctcgccggaagcggctgtgggcgggccgatcggactggtgcaggaaggagacctcattacgatcgacgccgaccggaatctgatcgaggtcaaggtttcaccggacgaaatgacaagaagaaaatctctgtggaaggaaccccctctccgatacacaaaaggaatcatggccaaataccgtcttctcgtcaaaagtgccagcgaaggcgccgtgacagactga

SEQ ID NO: 316 - protein, 557 aa, Leptospirillum sp.
MKKPFRSRTITQGVERSPNRAMLRAVGFQDGDFEKPIIGVANGYSTITPCNMGLNSLALRAEDAIRQRGAMPQMFGTITVSDGISMGTEGMKFSLVSREVIADSIETAVSAQSMDGVIAIGGCDKNMPGALIAMGRMNIPSIFVYGGTIKPGHWEGQDLTVVSSFEAVGAYSAGKMDEATLTEIERHACPGAGSCGGMFTANTMSSAIEAMGMSLPYSSTMAAEDLEKAESAAESARVLVQAVLNDLRPRQILTRKAFENAIAVLMAVGGSTNAVLHLLAIARSVDVPLSIDDFEHIRRKVPVLCNLKPSGAYVATQLHAVGGIPLVMRMLLDNGLLHGDALTITGKTISETLRDVPSRPPAGQDVVLPFDKPVYREGHLAILKGNLAPEGSVAKISGIKHRSITGPARVFDSEERCMAAILAREIRPGDIVVIRYEGPKGGPGMREMLAPTSALIGEGLGDSVGLITDGRFSGGTYGMVVGHVSPEAAVGGPIGLVQEGDLITIDADRNLIEVKVSPDEMTRRKSLWKEPPLRYTKGIMAKYRLLVKSASEGAVTD

SEQ ID NO: 317 - DNA, 1677 bp, Leptospirillum sp.
atgaaagacaaccggagaagtcgtgtcacgaccgaaggcgtggagcgctctcccaaccgggccctgcttcgggccacggggttccgggacgacgattttggcaagccgattgtcggggtggcgaacgcccacagttccatcaccccctgcaatatggggatcgggaaactcgcttcgcgggcggaagaagctctccgcaaggccggctccatgccccagaccttcgggaccatcacggtgtcggacggaatctcgatgggcaccgaaggcatgaaatattccctcgtctcgagggaagtgattgccgattcgatcgaaacggtcgtgaacgcgcagagcatggacggccttctggcgttcgggggatgcgacaaaaacatgccgggggcactgatcgcgatgggccgtctcgacattccctccgtcttcgtctacggagggacgattcgtccgggacaccacaacggacaggacctgaccgtcgtcagcgccttcgaggccgtcggggaatatctcgcgaaccggatcgaccgggaagaacttctggcaatcgaacgccacgcctgtcccggagccggatcctgcggcgggatgtttaccgccaacaccatggcagccctgatcgaaaccatgggcatgagcctcccctattcctccacgatggccgccgaagacgcggaaaaatcggaaaacgcggaagagtccgcgaagatcctggtcaacgccatccggaaccagatccgtccccgccagattctgacgcggcatgccttcgaaaatgcgatcgcggtcacgatggccatcggagggacgaccaacgccgttctgcatctccttgccatcgcccgggcggtcgaggttccgctttcgatcgacgacttcgccgcaatccgggaacgggtccctgttctgtgcgatctcaagccatgggggcggtatgtggcaaccgaccttcaccgggcgggagggattccccaggtcatgaaaatcctgttgtcgaacggactgttgcatggggaagccctttccgtcaccggccggaccatcgcggaactgctggaaaacatcccggaagaccccccgaaagaagatcaggatgtgattcgtccgtttcgcgcgccggtcctcgaacgggggcatatcgccatcctccggggaaacctcgcccccgacggatcggtggccaaagtgacggcctcccgtcctgtggcattcacgggaccggcccgtgtcttcgattcggaagaagacggcatgaaggccattctggcaagagagatccgtccgggagatgtcgtagtcatccgttacgagggtcccgtgggaggaccgggcatgcgggaaatgctcgcaccgaccgccgcccttgtcggggaaggcctgggggagagcgtggcgctggtcacggatggacggttctccggaggaacccgggggatggtcgtgggtcatgttgcacccgaagcggccgtgggaggaccgatcgccctggttgccgacggcgatccggtcacggtcgaccccggacggagctgtctccggctcgatgtgccggaggaggaatttctccgccggcaggccgcatggcgtccccgtccgccccgcaccctccggggggttctggcgaagtacgcccggcaggtctcttcggccagcgaaggcgccgtcaccgactga

SEQ ID NO: 318 - protein, 558 aa, Leptospirillum sp.
MKDNRRSRVTTEGVERSPNRALLRATGFRDDDFGKPIVGVANAHSSITPCNMGIGKLASRAEEALRKAGSMPQTFGTITVSDGISMGTEGMKYSLVSREVIADSIETVVNAQSMDGLLAFGGCDKNMPGALIAMGRLDIPSVFVYGGTIRPGHHNGQDLTVVSAFEAVGEYLANRIDREELLAIERHACPGAGSCGGMFTANTMAALIETMGMSLPYSSTMAAEDAEKSENAEESAKILVNAIRNQIRPRQILTRHAFENAIAVTMAIGGTTNAVLHLLAIARAVEVPLSIDDFAAIRERVPVLCDLKPWGRYVATDLHRAGGIPQVMKILLSNGLLHGEALSVTGRTIAELLENIPEDPPKEDQDVIRPFRAPVLERGHIAILRGNLAPDGSVAKVTASRPVAFTGPARVFDSEEDGMKAILAREIRPGDVVVIRYEGPVGGPGMREMLAPTAALVGEGLGESVALVTDGRFSGGTRGMVVGHVAPEAAVGGPIALVADGDPVTVDPGRSCLRLDVPEEEFLRRQAAWRPRPPRTLRGVLAKYARQVSSASEGAVTD

SEQ ID NO: 319 - DNA, 1698 bp, Halorhodospira halophila
atggcggataaccgtcgcagccgagtgatcacccagggcgtggcccgaacccccaaccgcgcgatgctgcgcgccgtcggtttccgggatgaggatttcgagaagccgatcatcggggtcggcaacgcgcacagtacgatcaccccctgcaacgtcgggatcggcgccatggcgcggcgcgccgaggaggcgctgcgcgaggtgggggcgatgccgatgaagttcggcaccatcaccgtctccgacgggatcaccatgggcaccgagggcatgaagtactccctggtctcccgcgaggtgatcgccgattcgatcgagacggtgggcggtggccagcggatggacggcatgctcgccactggtggctgcgacaagaacatgcccggggcgatgatggccctggcccgtctggatatcccgggtatcttcgtctatggcggcaccatcaagccgggtcattacaagggcgaggatctcaccgtggtcagcgccttcgaggcggtggggcagtacaacgccggcaacctctccgaggccgatctcaagggggtcgaggagaacgcctgccccggggcgggcgcctgtggcggcatgttcacggccaacaccatgtccagcgccttcgaggccatgggcatgagcctgatgggctcgtccaccgtctctgccgaggacgacgaggcccgggatgtggccgccgaggcgtcccgggtcctgatggacgctgtccatcacgaccggcgcccgtcctcgatcctcacccgcgaggccttcgagaacgcctttgcggtggtgatggccctgggcggctccactaacgccgtgctccacctgctggccatcgccaataccgccgaggtgccgttcgacctcgacgacgtcgagcgcatccgccgcaaggtgccggtactctgcgacctcaagccgtcgggccggttcgtgaccagtcagttccacgaggtcggcggcacgccgcaggtgatgcgcatcctcctggagcaggggctgttgcacggccactgccagaccatcaccgggcagaccatcgaggccctcatcggccacctgccgccggagccgccggcggatcaggagatcatcatgcccttcgatcggccgctctatcccgagggtcacctggcaatcctgcggggcaacctggctgaagagggtgccgtggccaaggtcagtggcatccaacagcgccgtatcagcggaccggcccgcgtgttcgattccgaggaggagtgcctggaggccatcctggccgacggggtgcaggccggtgacgtggtgatcgtccgctacgaggggcccaagggagggcccggcatgcgcgagatgctggcgcccacctcggcgatcatcggcaaggggctcggcgatgcggtggggctgatcactgacggccgtttctccggcgggacctacgggatggtggtcgggcacgtggcgcctgaggcctacgacggcgggaccatcgcgctgattgccgagggcgatacggtgaccatcgacgccgaccagaacctgcttcaggtggaggtggatgacgcggagctcgagcgtcgccgcagccagtggcaggtgccccggcctcgctaccgtcgcggggtgttgggcaagtatgcgcgcctggcggcctcggccagtcgcggtgcagtgaccgacgccgacctcttccccgagcaggagtag

SEQ ID NO: 320 - protein, 565 aa, Halorhodospira halophila
MADNRRSRVITQGVARTPNRAMLRAVGFRDEDFEKPIIGVGNAHSTITPCNVGIGAMARRAEEALREVGAMPMKFGTITVSDGITMGTEGMKYSLVSREVIADSIETVGGGQRMDGMLATGGCDKNMPGAMMALARLDIPGIFVYGGTIKPGHYKGEDLTVVSAFEAVGQYNAGNLSEADLKGVEENACPGAGACGGMFTANTMSSAFEAMGMSLMGSSTVSAEDDEARDVAAEASRVLMDAVHHDRRPSSILTREAFENAFAVVMALGGSTNAVLHLLAIANTAEVPFDLDDVERIRRKVPVLCDLKPSGRFVTSQFHEVGGTPQVMRILLEQGLLHGHCQTITGQTIEALIGHLPPEPPADQEIIMPFDRPLYPEGHLAILRGNLAEEGAVAKVSGIQQRRISGPARVFDSEEECLEAILADGVQAGDVVIVRYEGPKGGPGMREMLAPTSAIIGKGLGDAVGLITDGRFSGGTYGMVVGHVAPEAYDGGTIALIAEGDTVTIDADQNLLQVEVDDAELERRRSQWQVPRPRYRRGVLGKYARLAASASRGAVTDADLFPEQE

SEQ ID NO: 321 - DNA, 1689 bp, Nitrococcus mobilis
atggccgataatcgccgcagccgcgtgatcacctacggtgtggcccgtacgcctaatcgggccatgctgcgcgctgtcggttttaccgacactgatttcgataaaccgatcgttggagtgggcaatgcccacagcaccatcacaccctgtaatgtgggcatcggtgcattagcggctcaggccgaacaggcgctgcgtgaagccggtgccatgccggtcagctttggcaccatcactatttctgatggtatatccatgggcacggaggggatgaagtactcgctggtctcgcgcgaggtcatagccgatgccatcgaaacggtaggcaacggccagtgcctggatggcatgctcgccaccggtggttgcgacaagaacatgccgggcgccatgattgccatagcacgcatgaatattccggcgatcttcgtttatggcggcaccatcaagccgggtcgctataagggtcaggatctgaccatcgtcagcgctttcgaggcggttggacagtatgccgccggcaaactctcagtcgaggatttgcagggcgtggaacgcaacgcttgccccggtgccggtgcctgcggcgggatgtacacggctaataccatgtccagcgccttcgaggccttgggtatgagcctgatgggctcctccaccctgtgcgcggaggatccggagaaagtgcagagtgcgcggcgctcggctcaagtcctggtagacgccatccaggaacagcgtttaccgcgtgccataatgacccgccaggcgttcgaaaacgcctttgcggtggtcatggcgctcggcggatcgaccaatgccgtgctgcatttgttggcgatcgccaacgctgcggaggtcgattttagcattgacgatgtcgaaaccatccgccgccaggtgcccgtgctctgcgagctcaagccctccgggcgcttcgtaaccagccagtttcatgaggtcggcggtactccgcaggtcatgaagatccttttggcccacggcttattgcacggcgcttgccttactgtttccgggcattctattgctgaattgttggccgacataccggccgagccgccgagcgaccaggatatcattcggcctttcaagcagccgctgtacccgcagggacatctcgccatcctgcgcggcaatctggcggaggagggtgccgtcgccaaggtcaccggcatcaaacagcgccggatcacaggtccggcacgggttttcgactccgaagagggtgccctggaggcgattctggcggatcaaatcgtggcgggtgacatcgtcgtgattcgttatgagggcccgaagggtgggccgggcatgcgcgagatgctggcgccgacctcggcgatcatcggtaaaggtttgggtgatgcggtaggtcttattaccgacgggcgcttctccggtggtacctatgggatggtggtcggtcatgttgcaccagaggcggcagtcggcggtacgattgccttggtgcgggagggtgatgaaatcacgatcgatgccgatcgcaatctgctgatgctccatgtcgccgacacggaaattgtccagcgccgagccgcctggcagccgccacggcctatttatcgtcgcggtgtgctcgcgaagtacgccaagttggtctcctcggcgagcattggagcggttacggacaaagatctattcgactga

SEQ ID NO: 322 - protein, 562 aa, Nitrococcus mobilis
MADNRRSRVITYGVARTPNRAMLRAVGFTDTDFDKPIVGVGNAHSTITPCNVGIGALAAQAEQALREAGAMPVSFGTITISDGISMGTEGMKYSLVSREVIADAIETVGNGQCLDGMLATGGCDKNMPGAMIAIARMNIPAIFVYGGTIKPGRYKGQDLTIVSAFEAVGQYAAGKLSVEDLQGVERNACPGAGACGGMYTANTMSSAFEALGMSLMGSSTLCAEDPEKVQSARRSAQVLVDAIQEQRLPRAIMTRQAFENAFAVVMALGGSTNAVLHLLAIANAAEVDFSIDDVETIRRQVPVLCELKPSGRFVTSQFHEVGGTPQVMKILLAHGLLHGACLTVSGHSIAELLADIPAEPPSDQDIIRPFKQPLYPQGHLAILRGNLAEEGAVAKVTGIKQRRITGPARVFDSEEGALEAILADQIVAGDIVVIRYEGPKGGPGMREMLAPTSAIIGKGLGDAVGLITDGRFSGGTYGMVVGHVAPEAAVGGTIALVREGDEITIDADRNLLMLHVADTEIVQRRAAWQPPRPIYRRGVLAKYAKLVSSASIGAVTDKDLFD

SEQ ID NO: 323 - DNA, 1692 bp, Alkalilimnicola ehrlichei
atgagtgagaaccgccgcagtcgggtcgtgaccgcaggcctgcgccgcacccccaaccgggccatgctgcgcgccaccggcttccgggacgaggacttcgacaagcccatcatcggcgtcgccaacgcccacagcaccatcaccccctgcaacatgcatatcgccgcgctcacccggcgggcggtggaggcgttgcaggcggccggtgccatggcaccggaatttggcgtgcccaccgtctcggacggcatcgccatgggcacgccggggatgcgctactcgctggtctcgcgcgaggtgatcgccgacgccatcgagacggtgtgcgagggccagagcctggacggcgtgctggccaccggcggctgcgacaagaacatgcccggggctatgatcgccatcgcgcgcatgaacataccggccctgtttgtctacggcggcaccatccgccccggctactacaagggcgagcggctggacatcgtctcggcgttcgaggcggtgggccaggcctccgcgggcaggatgagtgacgaggacctgcttggggtggagcgcaacgcctgccccggcgccggctcctgtggcgggatgtacaccgccaacaccatgtccagcgccttcgaggccatgggcatgagcctgcccgccagctccaccgtggccgccgaggcggaggagaagggcgacgacgtggcggccgccgcgcgggtgctgatggaggcggtgcgggcggatcgcaagccccgcgacatcctcacccgcgaggccttcgagaacggcttcgccctggtgatggccgtgggcgggtccaccaacgcggtgctgcacttgctggccatcgccgatgcggccgatgtgccgttgtcgctggacgacgtggagcgtatccggcagcaggtgcccgtgctctgcgatctgcggccctcgggccgctacgtgaccactgaatttcacgaggtgggcggcacgccgcaagtgctgcgcctgctgctggacgcgggcctgctccacggcgactgcctcactattaccgggcagacgcttgccgagaccctggccgacgtgcccccgacccccgcgaaggatcaggacatcatccggaccctggacaaccccctctacccggtgggccatctggccatcctgcgtggaaacctggcagaggagggggccgtggccaaggtgtccggccttaagcagcgccgcatcgtcggaccggcgcgggtattcgagggtgaggaggactgcctggaggcgatcctggccggccagattaagcccggcgacgtggtggtcatccgccacgaggggccgaagggcgggcccggcatgcgcgagatgctctcgcccaccgcggcgttgatgggggccgggctgggggagagcgtcggcctgatcaccgatgggcgcttctccggtggcacccgggggctggtggtgggccacgtggcgccggaggccgcagcgggtggcaccatcgccctggtccgggaaggcgacaccgtcaccatcgatgcggacgccaaccggctcaccctggaggtggacgaggcggagctcgcccgccggcgtgcggcctggcagccgccggaaccgagagcgacccggggcgtattgggcaagtacgcgcagatggtcggctcggcggcgcagggtgcggtcaccgatcgctggagcggcggcgcgtga

SEQ ID NO: 324 - protein, 563 aa, Alkalilimnicola ehrlichei
MSENRRSRVVTAGLRRTPNRAMLRATGFRDEDFDKPIIGVANAHSTITPCNMHIAALTRRAVEALQAAGAMAPEFGVPTVSDGIAMGTPGMRYSLVSREVIADAIETVCEGQSLDGVLATGGCDKNMPGAMIAIARMNIPALFVYGGTIRPGYYKGERLDIVSAFEAVGQASAGRMSDEDLLGVERNACPGAGSCGGMYTANTMSSAFEAMGMSLPASSTVAAEAEEKGDDVAAAARVLMEAVRADRKPRDILTREAFENGFALVMAVGGSTNAVLHLLAIADAADVPLSLDDVERIRQQVPVLCDLRPSGRYVTTEFHEVGGTPQVLRLLLDAGLLHGDCLTITGQTLAETLADVPPTPAKDQDIIRTLDNPLYPVGHLAILRGNLAEEGAVAKVSGLKQRRIVGPARVFEGEEDCLEAILAGQIKPGDVVVIRHEGPKGGPGMREMLSPTAALMGAGLGESVGLITDGRFSGGTRGLVVGHVAPEAAAGGTIALVREGDTVTIDADANRLTLEVDEAELARRRAAWQPPEPRATRGVLGKYAQMVGSAAQGAVTDRWSGGA

SEQ ID NO: 325 - DNA, 1695 bp, Deinococcus geothermalis
atgacggacacccgcaccaagcgcagaatgaactggaacagtcaccacatcacgcagggtgacgagcgggcgcccaaccgcgcgatgctgcgggcggtgggcttcgaagacggcgacttcgacaaggcgatcatcggggtggcgcacgcccagagcaacatcacgccctgtaacaacgggctgggcgaactcgccgaccacatcaccggtgcgcttcgcgagggcggagcgatgccgcaggtgtacggcaccatcacggtgtctgacggcatcagcatgggcaccgagggcatgaagtgctctcttgtcagccgggaagtgatcgcagactccatcgaaaccgtctcgcgtgggcaatcgcacgacggcctgattgtggtgggcggctgcgacaagaatatgcccggcgcaatgatcggcatcgcccggttgaatattcccgcgatcttcgtgtacggcgggaccatcaaaccggggcactatcagggcaaagacctcaccatcgtttcggtcttcgaggcggtgggggcctacggcgcgggcaagatgagccgcgaggacttcgagcagatcgagaaacgcgcctgtcccggcaacggttcctgtggcggcatgtacaccgccaacaccatgagcagtgccttcgaggcgatgggcatgagcctgccctattcgtccaccatgagtgccgtggacgccgaaaaggccgtttcggctgcggacagcgcccgcgccctgatccggttgatcgagcaggacatccgcccgctggacatcctgacgaaaaaagcctttgagaacgccatcacggtggtcatggcggtgggcggctcgaccaacgccgtgctgcacctgatggcgattgcccacgcctgcggtgttgacctcacgctggaagacttcgagcgcattcgcgagcgcacgccggtcttctgtgaccttaagcccagtggaaagtacgtcgccacggatctgcacgaggtcggcggcattccgcgcgtgatgaagatgctgctcaaagcgggcttgctgcacggcgactgcctgacagtgaccggacagacggtggccgagaacctggcggacgtgcccgaccagcccgaccccggccaggacgtcattctgcccttcgatcagccgctctactcgcaggggcacctcgccatcttgcggggcaacctggccccggaaggcagtgtcgccaagatcagcggcctgcggcagatcaagatcaccggtcccgcccgcgtctttgattcggaagaagagtgcatggcggcgatcatgggcgatcagatcaaggccggtgacgtgatcgtgattcgctacgaaggccctaagggcggccccggcatgcgcgagatgctctcgcccaccagcgcgatcatcggcaaaggcctgggcgacagcgtggggctgatcacagacggacgcttcagcggcggcacctacggcctggtggttggccacgtcgcgcccgaagcctatgtaggcggccccatcgcgctggtgcaggaaggcgacatcatcgagctgaacgccgaaacctgcgagctgacgctgcatgtggacgacgcagaactggagcgccgccgcgccgcgtgggtggccccggaaccgcgctaccggcggggcgtcctggcaaagtacgcgcgactagtaggcagtgcggcgcggggagcggtgaccgattag

SEQ ID NO: 326 - protein, 564 aa, Deinococcus geothermalis
MTDTRTKRRMNWNSHHITQGDERAPNRAMLRAVGFEDGDFDKAIIGVAHAQSNITPCNNGLGELADHITGALREGGAMPQVYGTITVSDGISMGTEGMKCSLVSREVIADSIETVSRGQSHDGLIVVGGCDKNMPGAMIGIARLNIPAIFVYGGTIKPGHYQGKDLTIVSVFEAVGAYGAGKMSREDFEQIEKRACPGNGSCGGMYTANTMSSAFEAMGMSLPYSSTMSAVDAEKAVSAADSARALIRLIEQDIRPLDILTKKAFENAITVVMAVGGSTNAVLHLMAIAHACGVDLTLEDFERIRERTPVFCDLKPSGKYVATDLHEVGGIPRVMKMLLKAGLLHGDCLTVTGQTVAENLADVPDQPDPGQDVILPFDQPLYSQGHLAILRGNLAPEGSVAKISGLRQIKITGPARVFDSEEECMAAIMGDQIKAGDVIVIRYEGPKGGPGMREMLSPTSAIIGKGLGDSVGLITDGRFSGGTYGLVVGHVAPEAYVGGPIALVQEGDIIELNAETCELTLHVDDAELERRRAAWVAPEPRYRRGVLAKYARLVGSAARGAVTD

SEQ ID NO: 327 - DNA, 1695 bp, Polynucleobacter sp.
atgaaacgcctcaatgaacgctctcgcatggttaccgagggggtcgctcgcgcacccaatcgttcgatgtactacgcgatgggttacgaagaaaaggatttcgtaaaaccaatggttggcgttgcaaacggccactccactattaccccttgcaatagtggcttacaaaaattagctgatgccgcagttgaagctctagaagcagctggcgcaaaagcacaagtatttggtacgccaaccgtttctgatggtattggtatgggtactgagggtatgaagtattccctcgtctcacgagaagtgattgctgacagtattgaagtttgtgtaaacggtctttggcaagatggcgtagtagtcattggtggctgcgataaaaatatgcctggtggcatgatggctttagctcgcacgaatgtacctggcatctatgtatatggtggcacgattaagccaggccactttaaaggcaaggaattgaatattgtttctgcatttgaagcagttggtgaatttacctccggtcgattgagtgaagaagatttaaaaggtgttgagcaacacgcctgcccaggtagcggctcttgcggtggaatgtacacggccaataccatgagctcttcatttgaggctttgggtatgagcttgccctactcttctacgatggcaaacgttgacgctgaaaaagtagcgagcgctgccgaatcagcgcgcgtcctcgttgaagccgttaaaaacaacctgcgcccacgcgacatcattaccaagaaatccgttgagaatgcggttagcgtcatcatggcagttggcggttcaaccaatgcagtgttgcatttcttggcgattactagtgccgctgaaattgattggacaattgatgactttgaacggattcgtaagcaagtcccagtcatcgttgatatgaaaccctctggcacttatttagcaactgacttacaccaagctggcggtattccacaagtcatgaagattttgcttgacggtggcctgcttcatggcgattgcatcaccattaccggaaaaactattgctgaagtattaaaagatgttccatcagtgccgcgcgctgatcaaaaagtcattcgcacgctagacaacccactctacaagcaaggtcacttagcgattctgaagggcaatatttctccagaagggtgcgttgccaaaattactggcctcaagaatccatcgattactggcccagctcgagtctttgattctgaagatgatgcgatggctgccatcatggctcagaagatcaaagatggcgacatcgtggtgattcgttacgaaggccctaaaggcggtcctggtatgcgtgaaatgcttgcccctacctctgccctagttggtcaaggtttaggcgagtcagttggcctcatcaccgatggtcgcttctctggtggtacttggggcatggtagttggtcacgttgctcctgaggcctttgtagggggcacaattgccctcatcaacgaaggtgactcagtcacgatagatgctcaccaacttcttattcagctcaacgtcagcgaagaagaaattgctaagcgacgcgcagcttggaaacaacctaagccacgctatacccgcggcttacttgcgaagtatgcaagccttgctagtagtgcgagcaaaggtgctgtaaccgatttgaatttagatttgacctaa

SEQ ID NO: 328 - protein, 564 aa, Polynucleobacter sp.
MKRLNERSRMVTEGVARAPNRSMYYAMGYEEKDFVKPMVGVANGHSTITPCNSGLQKLADAAVEALEAAGAKAQVFGTPTVSDGIGMGTEGMKYSLVSREVIADSIEVCVNGLWQDGVVVIGGCDKNMPGGMMALARTNVPGIYVYGGTIKPGHFKGKELNIVSAFEAVGEFTSGRLSEEDLKGVEQHACPGSGSCGGMYTANTMSSSFEALGMSLPYSSTMANVDAEKVASAAESARVLVEAVKNNLRPRDIITKKSVENAVSVIMAVGGSTNAVLHFLAITSAAEIDWTIDDFERIRKQVPVIVDMKPSGTYLATDLHQAGGIPQVMKILLDGGLLHGDCITITGKTIAEVLKDVPSVPRADQKVIRTLDNPLYKQGHLAILKGNISPEGCVAKITGLKNPSITGPARVFDSEDDAMAAIMAQKIKDGDIVVIRYEGPKGGPGMREMLAPTSALVGQGLGESVGLITDGRFSGGTWGMVVGHVAPEAFVGGTIALINEGDSVTIDAHQLLIQLNVSEEEIAKRRAAWKQPKPRYTRGLLAKYASLASSASKGAVTDLNLDLT

SEQ ID NO: 329 - DNA, 1692 bp, Polynucleobacter necessarius
atgaaacgcctaaatgaacgctcgcgcatggtcacagaaggggtcgcacgcgcacctaatcgttcgatgtattacgcaataggttacgaagaaaaggatttcgtaaagccaatggttggcgttgcgaatggtcactccactatcaccccttgtaatagtggtttacaaaaattagccgatgctgcagtttctgcgcttgaaggtgctggtgcaaaagcacaaatgtttggcaccccaaccgtttccgatggcataggcatgggcacagaaggcatgaagtattcactcgtgtcacgcgaagtgattgctgacagtattgaaacttgtgtaaatggactgtggcaagacggtgtagttgtgattggcggctgcgataaaaatatgccaggcggcatgatggctttagctcgcaccaatgtgcccggcatctatgtatatggcggcacaattaagccaggccactacaaaggtaaagaccttaatatcgtttcagcgtttgaagcagttggtgaatttacctccggcagactcagcgaagaggatttaaaaggtgtagaacaacatgcctgtccgggtagcggctcctgcggtggtatgtataccgccaacacaatgagctcggcctttgaggccttaggcatgagcctcccctactcctcaacgatggcaaacgaagatgcagaaaaagtagcaagcacacatgattctgctgtcgtattggttgaagcgatcaaaaagaacttgcgtccacgcgacatcattaccaagaaatcgattgagaacgctgttagcgtaatcatggctgttggtggatctacaaatgcggtgctgcatttcttggcgattactagcgccgctgaaatcgattggaccattgatgattttgaacgcattcgtaagcgcgttcctgtaatcgtggatatgaaaccatcgggcacctaccttgctaccgatttgcatcaagctggcggcattcctcaagtgatgaagattttgctcgacgacggattgctccacggcgattgcatgactatcactggcaaaacagttgcggaagtgttgaaagatgttccatccgtaccgcgcgccgatcagaaagtgatccgtaccttagataatcctttgtataaacaaggtcacttggcaatcttgaaaggcaatatctcaccagagggttgtgtgaccaagataaccggcctcaaaaatccatcgatcaccggcccagcacgcgtctttgattctgaagatgatgctatggcagccatcatggcacagaagattaaagatggtgacatcgtggtcattcgctatgaaggccctaaaggcggccctggtatgcgcgaaatgcttgcccccacctctgccctagttggtcaaggtttaggcgaatctgtggggcttattaccgatggccgcttctctggtggcacttggggcatggtcgttggccacgtggcaccggaagcttatgtcggtggaaccatcgccctcattcatgagggtgactctgtcacgatcgatgcgcataagctactcattcagctgaatgtagatgatgcagagatcgctaaacgtcgcgcagcctggaagcaacccaagccacgctacacccgcggcttgcttgcaaagtatgccaaacttgctagcaccgcaagcaaaggggcggtgaccgacttaaatttgaatgattag

SEQ ID NO: 330 - protein, 563 aa, Polynucleobacter necessarius
MKRLNERSRMVTEGVARAPNRSMYYAIGYEEKDFVKPMVGVANGHSTITPCNSGLQKLADAAVSALEGAGAKAQMFGTPTVSDGIGMGTEGMKYSLVSREVIADSIETCVNGLWQDGVVVIGGCDKNMPGGMMALARTNVPGIYVYGGTIKPGHYKGKDLNIVSAFEAVGEFTSGRLSEEDLKGVEQHACPGSGSCGGMYTANTMSSAFEALGMSLPYSSTMANEDAEKVASTHDSAVVLVEAIKKNLRPRDIITKKSIENAVSVIMAVGGSTNAVLHFLAITSAAEIDWTIDDFERIRKRVPVIVDMKPSGTYLATDLHQAGGIPQVMKILLDDGLLHGDCMTITGKTVAEVLKDVPSVPRADQKVIRTLDNPLYKQGHLAILKGNISPEGCVTKITGLKNPSITGPARVFDSEDDAMAAIMAQKIKDGDIVVIRYEGPKGGPGMREMLAPTSALVGQGLGESVGLITDGRFSGGTWGMVVGHVAPEAYVGGTIALIHEGDSVTIDAHKLLIQLNVDDAEIAKRRAAWKQPKPRYTRGLLAKYAKLASTASKGAVTDLNLND

SEQ ID NO: 331 - DNA, 1704 bp, Azoarcus sp.
atgtccgaccctacccgtccagcccggatcgatgaacgttcccgcaacgtgaccgaaggcgtgatgcgggcgcccaatcgatcgatgtactacgcgatgggctatcgggaaactgatttcggcaagccgatggttggcgtggcgagcgcacattcgacgatcacgccctgcaacagcgggctgcaaccgctggccgataccgtggccgcggccttgaaggaggccggggccaatccgcaactgttcggtactcccaccgtgtccgacggcatcggcatgggcaccgagggcatgaagtattcgctggtatcgcgggaagtgatcgccgacagcatcgagacctgcgtcaatgggctgtggcaggacggggtcgtcgtgatcggcggatgcgacaagaacatgcccggcggcatgatggcgcttgtccgcaccaacgtgcctggaatctatgtctatggcggcacgatcaaaccggggcattacaagggcagggatctgaacatcgtctcggttttcgaggcggtgggggaattcatcgcggggcagctcgacccggtcgatttcaaggaaatcgaaaagcgcgcctgccccggcagcggctcgtgcggcgggatgtacacggcaaacacgatgagcgccgcgttcgaggcgctcggcatgagcctgccatattcttcgacgatggccaacgaggacgctgagaagctcgcgagcgccgcggagtccgcccgggtgctggtggaggcgatcaaacgcggccttcgcccgcgcgacatcgtcacccgggaggcgatcgagaacgctgtcagcgtgatcatggcgacgggaggctcgaccaacgcggtgctgcactttctggcgattgcccacgcggccgaagtgccgtggacaatcgacgacttcgagcgcattcggcgtcgcgtgccggtcatcgtcgacatgaagccgtccgggcgctacctcgcgaccgatctccatcaggcaggcggcatcccgcaggtgatgaagctgctgctcgacgccgggctgctgcatggcgcgtgcgtcacgatcaccgggcagacgatcgcggaggtcctggagaacgtgccggcggcaccgcgtgccgatcagggcgtcatccggacgctgtccgatccgctgtacgcggagggccatctggcgatcctcaggggcaacctctcgccggaaggctgcgtggcgaagatttcgggcctgaagaatcccgccatcaccggcccggcgcgcgtcttcgactccgaggacgacgcgatggcggcgatcatggcgcgccggatcgtggagggtgacgtcgtggtaatccgctacgagggacccaagggcggccccggcatgcgcgagatgctcgccccgacgtcggcgctcgtcgggcaggggctgggagagtcggtcgggctgatcactgacggccgcttctcgggaggcacctggggcatggtcgtcggccacgtttcccccgaagcgttcgtcggtggcccgattgcgctggttcgcgaaggggactcggtcacgatcgacgcgcaccggcagctcgtccagctgaatgtcggtgatgaagagctcgcgcgccgagccgccgactggacgccgccgtccccgcgctacacccgcggcgtgctggcgaagtttgcgaagttcgccagttccgcgagcaagggcgcggttaccgatctggacttgtag

SEQ ID NO: 332 - protein, 567 aa, Azoarcus sp.
MSDPTRPARIDERSRNVTEGVMRAPNRSMYYAMGYRETDFGKPMVGVASAHSTITPCNSGLQPLADTVAAALKEAGANPQLFGTPTVSDGIGMGTEGMKYSLVSREVIADSIETCVNGLWQDGVVVIGGCDKNMPGGMMALVRTNVPGIYVYGGTIKPGHYKGRDLNIVSVFEAVGEFIAGQLDPVDFKEIEKRACPGSGSCGGMYTANTMSAAFEALGMSLPYSSTMANEDAEKLASAAESARVLVEAIKRGLRPRDIVTREAIENAVSVIMATGGSTNAVLHFLAIAHAAEVPWTIDDFERIRRRVPVIVDMKPSGRYLATDLHQAGGIPQVMKLLLDAGLLHGACVTITGQTIAEVLENVPAAPRADQGVIRTLSDPLYAEGHLAILRGNLSPEGCVAKISGLKNPAITGPARVFDSEDDAMAAIMARRIVEGDVVVIRYEGPKGGPGMREMLAPTSALVGQGLGESVGLITDGRFSGGTWGMVVGHVSPEAFVGGPIALVREGDSVTIDAHRQLVQLNVGDEELARRAADWTPPSPRYTRGVLAKFAKFASSASKGAVTDLDL

SEQ ID NO: 333 - DNA, 1674 bp, Burkholderia phymatum
atgccgtacaaccgtcgttcgaagaacatcacgcaaggcgtcgcgcgttcgccgaaccgctcgatgtattacgcgctcggctaccagaaggcagacttcgacaagccgatgatcggcatcgccaacggccactcgaccatcacgccgtgcaacgcgggcctgcaacgactcgccgacgccgccgtcgaagccgtcaagcgcagcgatgcgaatccgcagaccttcggtacgccgaccatttcggacggcatgtcgatgggcacggagggcatgaagtactcgctcgtgtcgcgcgaagtgatcgccgactgcatcgagacctgcgtgcaggggcaatggatggacggcgtcgtcgtgatcggcggctgcgacaagaacatgccgggcggcatgatcggcctcgcgcgaatgaacgtgccaggcatctacgtgtacggcgggaccatcaagccgggcaactggaaaggcaccgacctgactatcgtgtcgtcgttcgaggcagtgggcgaattcacggcgggccgcatgtcgcaagaagacttcgaaggggtcgaacagaacgcctgcccgagcacgggctcgtgcggcggcatgtacacggccaacacgatgagctcgtcgttcgaagcgctcggtatgtcgctgctgtactcgtcgacaatggcgaacccggatcaggagaaagtggattcggcggccgagtcggcgcgcgtgctggtcgaagccgtcaagcaggatctcaagccgcgcgacatcattacgaagaagtcgatcgaaaacgccgttgcgctgatcatggcgacgggcggctcgacgaacgccgtgctgcactatctggccattgcgcacgcggcggaagtggactggtccatcgaagatttcgagcgcatgcgcaagaaagtgcccgtcatctgcgatctcaagccgtcgggcaagtatgtcgccaccgatctgcacaaggccggcggcatcccgcaggtgctgaagctgctgctcgatgcaggcctgctgcacggcgactgcatcacgatcacgggcaagacgatcgccgaagagctgaaggacgtgccagccaaaccgcgcgcggaccagaaggtgatctatccgatcgacaaggcgctttacagcgaaggccatctcgcgattctcaagggcaacctcgcggaagacggcgcggtcgcgaagatcaccgggctgaagaaccccgtcatcacagggcccgcacgcgtgttcgacgacgagcaaagtgcgatggaagccatcctcgccgaccagatcaaggcaggcgatgtcgtcgtgctgcgctatctcggcccgcaaggcggccccggcatgccggaaatgctggcgccgacctcggcgatcatcggcaagggtctcggcgaatcggtcggtcttatcacggatgggcgcttctcgggcggcacctggggcatggtggtgggtcacgtcgcgccggaagcgttcgtcggcggcacgatcgcactcgtgcaggaaggcgattcgatcaccatcgacgcccacaagctgctgttgcaactgaacgtcgacgacggcgaactgcagcgccgccgcgccgcatggaagcagcccgcgccgcgctatacgcgcggcgtgctggccaagttcgcggcgctcgcgaagccggccaacaagggcgccgtcaccggctga

SEQ ID NO: 334 - protein, 557 aa, Burkholderia phymatum
MPYNRRSKNITQGVARSPNRSMYYALGYQKADFDKPMIGIANGHSTITPCNAGLQRLADAAVEAVKRSDANPQTFGTPTISDGMSMGTEGMKYSLVSREVIADCIETCVQGQWMDGVVVIGGCDKNMPGGMIGLARMNVPGIYVYGGTIKPGNWKGTDLTIVSSFEAVGEFTAGRMSQEDFEGVEQNACPSTGSCGGMYTANTMSSSFEALGMSLLYSSTMANPDQEKVDSAAESARVLVEAVKQDLKPRDIITKKSIENAVALIMATGGSTNAVLHYLAIAHAAEVDWSIEDFERMRKKVPVICDLKPSGKYVATDLHKAGGIPQVLKLLLDAGLLHGDCITITGKTIAEELKDVPAKPRADQKVIYPIDKALYSEGHLAILKGNLAEDGAVAKITGLKNPVITGPARVFDDEQSAMEAILADQIKAGDVVVLRYLGPQGGPGMPEMLAPTSAIIGKGLGESVGLITDGRFSGGTWGMVVGHVAPEAFVGGTIALVQEGDSITIDAHKLLLQLNVDDGELQRRRAAWKQPAPRYTRGVLAKFAALAKPANKGAVTG

SEQ ID NO: 335 - DNA, 1674 bp, Burkholderia xenovorans
atgccatacaaccgtcgttcgaagaacatcacgcaaggtgtagcgcgttcgccgaatcgctcgatgtactacgcgctcggctacgaaaaagccgacttcgacaagccgatgatcggcatcgccaacggtcactcgaccatcacgccgtgcaacgcgggcctgcagcgtctcgccgatgccgcggtcgccgcgatcaaaggcgccgacgcgaacccacagatcttcggcacgccgacgatctcggacggcatgtcgatgggcaccgagggcatgaagtactcgctggtgtcgcgcgaagtgatttccgactgcatcgagacctgcgtgcaaggccagtggatggacggcgtggtcgtgatcggcggctgcgacaagaacatgccgggcggcatgatcggcatgctgcgcaccaacgtgccgagcatctacgtgtatggcgggacgattcgtccgggcaactggaagggcaccgacctgaccatcgtgtcgtcgttcgaggccgtgggcgaattcaccgccggccggatgtcgcaggaagatttcgaaggggtcgaacagaacgcgtgcccatccaccgggtcgtgcggcggcatgtacaccgccaacaccatgagctcgtcgttcgaagcgctcggcatgtcgctgctgtattcgtccacaatggccaatccggatcaggaaaaagtcgactcggccgccgaatcggcacgcgtgctggtcgaagcggtcaagcaggatctcaagccgcgcgacatcgtgacccgcaagtcgatcgaaaacgccgtggccgtgatcatggccaccggcggctcgaccaatgccgtgctgcactttctcgccatcgcgcatgcggccgaagtggagtggagcatcgaggacttcgagcgcatgcgcaagaaggtgccggtgatctgcaacctgaagccgtcgggccagttcgtggcgaccgatctgcacaaggccggcggcattccgcaagtcatgaagatcctgctcgacgcaggtctgttgcacggcgattgcatcacgatcaccggccgaaccctcgcggaagagttgaaggacgtgccggccaggccgcgcgccgatcagcaggtgattttcccgatcgagcaggcgctgtacaaggaaggccatctcgcgatcctcaagggcaacctggccgtggacggcgcggtcgccaagatcaccggcctgaagaatcccgtgatcaccggcccggcgcgcgtgttcgacgacgagcaaagcgcgctggaagcgattctggccgacaggatcgtcgcgggcgacgtggtggtgctgcgctatctcggcccgaagggcggccccggcatgccggagatgctcgcgccgacctcggcgatcatcggcaagggactcggcgagagcgtggggctcatcaccgacgggcgcttctcgggtggcacgtggggcatggtggtcgggcacgtcgcgccggaagccttcgtgggcggcacgatcgcgttcgtgcaggaaggcgactcgatcaccatcgacgcgcacaagctgctgctgcaactgaatatcgacgacgccgaactggagcgacgccgtgccgcatggcagcagccgaagccgcgctacacacgcggcgtgctggcgaagtactccgcattggctctgccggccaataagggcgccgtgacgggctaa

SEQ ID NO: 336 - protein, 557 aa, Burkholderia xenovorans
MPYNRRSKNITQGVARSPNRSMYYALGYEKADFDKPMIGIANGHSTITPCNAGLQRLADAAVAAIKGADANPQIFGTPTISDGMSMGTEGMKYSLVSREVISDCIETCVQGQWMDGVVVIGGCDKNMPGGMIGMLRTNVPSIYVYGGTIRPGNWKGTDLTIVSSFEAVGEFTAGRMSQEDFEGVEQNACPSTGSCGGMYTANTMSSSFEALGMSLLYSSTMANPDQEKVDSAAESARVLVEAVKQDLKPRDIVTRKSIENAVAVIMATGGSTNAVLHFLAIAHAAEVEWSIEDFERMRKKVPVICNLKPSGQFVATDLHKAGGIPQVMKILLDAGLLHGDCITITGRTLAEELKDVPARPRADQQVIFPIEQALYKEGHLAILKGNLAVDGAVAKITGLKNPVITGPARVFDDEQSALEAILADRIVAGDVVVLRYLGPKGGPGMPEMLAPTSAIIGKGLGESVGLITDGRFSGGTWGMVVGHVAPEAFVGGTIAFVQEGDSITIDAHKLLLQLNIDDAELERRRAAWQQPKPRYTRGVLAKYSALALPANKGAVTG

SEQ ID NO: 337 - DNA, 1674 bp, Burkholderia multivorans
atgtcgtacaaccgtcgctcgaagcacatcacgcaaggcgtcgcccgctcgccgaaccgttcgatgtattacgccctcggctatcagaaggaagatttcgacaagccgatgatcggcatcgccaacgggcattcgacgatcacgccgtgcaacgcggggctgcagcgcctgtccgacgcggccgtcgaggcgatcaaggcggccggcgcgaatccgcagatcttcggcacgcccacgatctcggacggcatgtcgatgggcaccgaagggatgaagtactcgctcgtgtcgcgcgaggtaatcgccgactgcatcgagacctgcgtgcagggccaatggatggacggcgtcgtggtagtcggcggctgcgacaagaacatgccgggcgggatgatcgcgctcgcgcggctgaacgtgccgggcatctacgtgtacggcgggacgatccgccccggccactggaaaggcaaggatctgacgatcgtctcggcgttcgaggcggtcggcgaattcacggccgggcgcatgtcggacgaggatttcgagggcatcgagcgcaacgcgtgcccgacgtcgggctcgtgcggcggcatgtacaccgcgaacacgatgagctcgtcgttcgaggcgctcggcatgtcgctgatgtattcgtcgacgatggcgaaccccgatcaggaaaaggtcgattcggcggccgaatcggcgcgtgtgctcgtcgaagcggtgaagcgcgacctgaagccgcgcgacatcatcacgaagcagtcgatcgagaacgcggtgtcgctgatcatggcgaccggcggctcgaccaatgcggtgctgcactatctcgcgatcgcgcatgcggccgaggtcgactggacgatcgacgacttcgagcggatccgcaagcgcgtgccggtgatctgcgacctgaagccgtcgggccagtacgtcgcgaccgacctgcaccgtgcgggcggcattccgcaggtgctgaagatcctgctcgatgcgggcctgctgcacggcgactgcgtcacgatcaccggccgcacgctcgccgaagagctgaaggacgtgccgtccgtgccgcgcgccgatcagcaggtgatcttcccgatcgagcgcgcgctgtacaaggagggccatctcgcgatcctgaagggcaatctcgccgaggacggcgcggtcgcgaagatcaccggcctgaagaacccggtgatcacgggcccggcgcgcgtgttcgacgacgagcaaagcgcgatggacgcgatcctcggcgacaagatccgcgccggcgacgtgctcgtgctgcgctatctcggcccgcaaggcgggcccggcatgccggaaatgctcgcgccgacgtcggcgatcatcggcaaggggctcggcgaatcggtcggcttcatcaccgacggccgcttctccggcggtacgtgggggatggtcgtcggccacgtcgcgcccgaggcgttcgtcggcggcacgatcgcgctcgtgcaggaaggcgactcgatcacgatcgacgcgcataagctgctgctgcagctgaacgtcgacgatgcggaactcgcgcgccgccgcgccgcatggaagcagccggcgccgcgctacacgcgcggcgtgctcgccaagtatgccgcgctcgcacggccggcgaatcggggtgcggtcacggggtga

SEQ ID NO: 338 - protein, 557 aa, Burkholderia multivorans
MSYNRRSKHITQGVARSPNRSMYYALGYQKEDFDKPMIGIANGHSTITPCNAGLQRLSDAAVEAIKAAGANPQIFGTPTISDGMSMGTEGMKYSLVSREVIADCIETCVQGQWMDGVVVVGGCDKNMPGGMIALARLNVPGIYVYGGTIRPGHWKGKDLTIVSAFEAVGEFTAGRMSDEDFEGIERNACPTSGSCGGMYTANTMSSSFEALGMSLMYSSTMANPDQEKVDSAAESARVLVEAVKRDLKPRDIITKQSIENAVSLIMATGGSTNAVLHYLAIAHAAEVDWTIDDFERIRKRVPVICDLKPSGQYVATDLHRAGGIPQVLKILLDAGLLHGDCVTITGRTLAEELKDVPSVPRADQQVIFPIERALYKEGHLAILKGNLAEDGAVAKITGLKNPVITGPARVFDDEQSAMDAILGDKIRAGDVLVLRYLGPQGGPGMPEMLAPTSAIIGKGLGESVGFITDGRFSGGTWGMVVGHVAPEAFVGGTIALVQEGDSITIDAHKLLLQLNVDDAELARRRAAWKQPAPRYTRGVLAKYAALARPANRGAVTG

SEQ ID NO: 339 - DNA, 1686 bp, Burkholderia cenocepacia
atggagctccccatgtcgtacaaccgccgctctaagaacatcacgcaaggcgtggcccgttcgccgaaccgctcgatgtattacgccctcggctaccagaaggacgatttcgataaaccgatggtcggtatcgcgaacggccactcgacgatcacgccgtgcaattccggcctgcagcgcctgtcggacgcggccgtggatgccgtgaaggcggccggcgcgaacccgcagatcttcggcacgccgacgatttcggacggcatgtcgatgggcaccgaagggatgaagtactcgctcgtgtcgcgcgaagtgatcgccgactgcatcgagacctgcgtgcagggccagtggatggacggcgtggtggtggtcggcggctgcgacaagaacatgcccggcggcatgatcgcgctcgcacgcctgaacgtgccgggcatctacgtgtacggcggcacgatccgcccgggcaactggaagggccgcgacctgacgatcgtgtcgtcgttcgaggccgtcggcgaattcaccgcgggccggatgtcgcaggaagacttcgaaggcgtcgagaagaacgcgtgcccgacgtcgggttcgtgcggcggcatgtacaccgcgaacacgatgagttcgtcgttcgaggcgctcgggatgtcgctgctgtattcgtcgacgatggcgaaccccgaccaggaaaaagtcgattcggccgccgaatcggcacgcatgctggtcgaggcggtgaagcgcgacctgaagccgcgcgacatcatcacgaaggaatccatcgagaacgcggtgtcggtgatcatggccaccggcggctcgaccaatgcggtgctgcactatctcgcgatcgcgcacgcggccgaagtcgactggacgatcgacgacttcgagcgcattcgcaagcgcgtgccggtgatctgcgacctgaagccgtcgggacaatacgtcgcgaccgacctgcaccgggccggcgggattccgcaggtgctgaagatcctgctcgatgcagggctgctgcacggcgactgcatgacgatcaccggccgcacgatcgccgacgagctgaaggacgtgccggccgtgccgcgcgcggaccagcatgtgatcttcccgatcgaccgcgcactgtacaaggaaggccacctcgcgatcctgaagggcaatctcgcggaagacggcgcggtcgcgaagatcaccggcctgaagaacccggtgatcacgggcccggcgcgcgtgttcgacgacgaacagagcgcaatggacgcgatcctcggcgaccggattcgcgcgggcgacatcctcgtgctgcgctacctcggcccgcagggtggccccggcatgccggaaatgctcgcgccgacttccgcgatcatcggcaaggggctcggcgaatcggtcggcttcatcacggacggacgcttctcgggcggcacttggggcatggtggtcggccacgtcgcgccggaggcgttcgtcgggggcacgatcgcgctggtgcaggaaggcgattcgatcacgatcgacgcgcaccggctgctgctgcaactgaacgtcgacgaggcggaactcgcacggcgccgtgccgcgtggcgacagccggcgccgcgctatacgcgcggggtgctcgcgaaattcgcggcgctcgcccgaccggcgaaccagggagcggtcacgggttga

SEQ ID NO: 340 - protein, 561 aa, Burkholderia cenocepacia
MELPMSYNRRSKNITQGVARSPNRSMYYALGYQKDDFDKPMVGIANGHSTITPCNSGLQRLSDAAVDAVKAAGANPQIFGTPTISDGMSMGTEGMKYSLVSREVIADCIETCVQGQWMDGVVVVGGCDKNMPGGMIALARLNVPGIYVYGGTIRPGNWKGRDLTIVSSFEAVGEFTAGRMSQEDFEGVEKNACPTSGSCGGMYTANTMSSSFEALGMSLLYSSTMANPDQEKVDSAAESARMLVEAVKRDLKPRDIITKESIENAVSVIMATGGSTNAVLHYLAIAHAAEVDWTIDDFERIRKRVPVICDLKPSGQYVATDLHRAGGIPQVLKILLDAGLLHGDCMTITGRTIADELKDVPAVPRADQHVIFPIDRALYKEGHLAILKGNLAEDGAVAKITGLKNPVITGPARVFDDEQSAMDAILGDRIRAGDILVLRYLGPQGGPGMPEMLAPTSAIIGKGLGESVGFITDGRFSGGTWGMVVGHVAPEAFVGGTIALVQEGDSITIDAHRLLLQLNVDEAELARRRAAWRQPAPRYTRGVLAKFAALARPANQGAVTG

SEQ ID NO: 341 - DNA, 1686 bp, Burkholderia mallei
atggagttccccatgtcgtacaaccgccgctcgaagaacatcacgcaaggcgtggcccgttcgccgaaccgctcgatgtattacgcgctcggctatcagaaggaagatttcgacaagccgatgatcggcatcgcgaacggccactcgacgatcacgccgtgcaacgcgggcctgcagcgtctgtcggacgccgccgtcgcggccgtcaaggacgccggcgcgaatccgcagatcttcggcacgccgacgatctcggacggcatgtcgatgggcaccgaagggatgaagtactcgctcgtgtcgcgcgaggtgatcgccgattgcatcgagacctgcgtgcagggccaatggatggacggcgtcgtcgtcgtgggcggctgcgacaagaacatgccgggcggcatgatcgcgctcgcgcggatcaacgtgccgggcatctacgtgtacggcggcacgatccgccccggccactggaaaggccacgacctgacgatcgtgtcgtcgttcgaggcggtcggcgagttcaccgccggacgcatgtcgcaggaggatttcgaaggggtcgaaaagaacgcgtgcccgacgacgggctcgtgcggcggcatgtataccgcgaacacgatgagctcgtcgttcgaggcgctcggcatgtcgctgctgtactcgtcgacgatggccaatcccgatcaggagaaggtcgattcggcggcggaatcggcgcgcgtgctggtcgaggcggtgaagaaggacctgaagccgcgcgacatcatcacgaagcagtcgatcgagaacgcggtgtcggtcatcatggccacgggcggctcgaccaacgcggtgctccactatctggcgatcgcgcacgcggccgagatcgactggtcgatcgaggatttcgagcgcatcaggaagcgcgtgccggtgatttgcgacctgaagccgtcgggccagtacgtcgcgaccgatctgcacgcggcgggcggcattccgcaggtgatgaagctgctgctcgacgcgggcctgctgcacggcgactgcatgacgatcacgggccgcacgctcgccgaggagctgaaggacgtgccgagcgtgccgcgcgccgatcagaaggtgatccatccgatcgaccaggcgctgtacaaggaaggccacctcgcgatcctgaagggcaacctcgccgaggacggcgcggtcgcgaagatcaccggcctgaagaacccggtcatcaccggcccggcgcgcgtgttcgacgacgagcagagcgcgctcgccgcgatcctcgacgacaggatccgcgcgggcgacgtcgtcgtgctgcgctacctcggcccgcaaggcggcccggggatgcccgagatgctcgcgccgacatcggcgatcatcggcaagggcctcggcgaatcggtcggcctgatcaccgacggccgcttctccggcggcacgtgggggatggtggtcggccacgtcgcgccggaagcgttcgtcggcggcacgatcgcgctcgtgcaggaaggcgattcgatcacgatcgacgcgcacaagctgctgctgcaattgaacgtcgacgacgccgaactcgcgcgccgccgcgccgcatggaagcagccggcgccgcgctacacgcgcggcgtgctcgcgaagtacgcggcgctcgcccgcccggcgaaccagggcgccgtcacgggctga

SEQ ID NO: 342 - protein, 561 aa, Burkholderia mallei
MEFPMSYNRRSKNITQGVARSPNRSMYYALGYQKEDFDKPMIGIANGHSTITPCNAGLQRLSDAAVAAVKDAGANPQIFGTPTISDGMSMGTEGMKYSLVSREVIADCIETCVQGQWMDGVVVVGGCDKNMPGGMIALARINVPGIYVYGGTIRPGHWKGHDLTIVSSFEAVGEFTAGRMSQEDFEGVEKNACPTTGSCGGMYTANTMSSSFEALGMSLLYSSTMANPDQEKVDSAAESARVLVEAVKKDLKPRDIITKQSIENAVSVIMATGGSTNAVLHYLAIAHAAEIDWSIEDFERIRKRVPVICDLKPSGQYVATDLHAAGGIPQVMKLLLDAGLLHGDCMTITGRTLAEELKDVPSVPRADQKVIHPIDQALYKEGHLAILKGNLAEDGAVAKITGLKNPVITGPARVFDDEQSALAAILDDRIRAGDVVVLRYLGPQGGPGMPEMLAPTSAIIGKGLGESVGLITDGRFSGGTWGMVVGHVAPEAFVGGTIALVQEGDSITIDAHKLLLQLNVDDAELARRRAAWKQPAPRYTRGVLAKYAALARPANQGAVTG

SEQ ID NO: 343 - DNA, 1674 bp, Ralstonia eutropha
atggcattcaacaaacgctcccgcaacatcacgcaaggtgtggcgcgttccccgaaccgctcgatgtactacgccctgggctaccagaaggaagacttcgacaagcccatggtcggcatcgccaacggccactcgacgatcacgccgtgcaacgccggcctgcagcgcctggccgacgccgcgatcgacgccgtgaaggcctcggacgccaatccgcaggtattcggcacgccgacgatctccgacggcatgtcgatgggcaccgagggcatgaagtactcgctgatctcgcgcgaagtcattgccgactgcatcgagaccgccgcccagggccagtggatggacggcgtggtggtgatcggcggctgcgacaagaacatgccgggcggcatgatcgcgctcgcgcgcaccaatgtgccgggcatctacgtctatggcggcaccatcaagcccggcaactggaagggcaaggacctgaccatcgtgtcgtcgttcgaggccgtgggcgaattcaccgccggccgcatgagcgaagaagatttcgagggcgtggaaaggaacgcttgtccgtcgaccggatcgtgcggcggcatgtacaccgccaatacgatgagctcgtcgttcgaggcgcttgggatgtcgctgctgtattcgtcgacgatggccaaccccgatcaggaaaaggtcgatagcgctgccgaatcggcgcgcgtgctggtcgaggcgatcaagaaggacatcaagccgcgcgacatcatcacgcgcaagtcgatcgaaaacgccgtcgcgctgatcatggccaccggtggctcgaccaacgcggtgctgcactacctggccattgcgcactcggccgaagtcgaatggaccatcgacgatttcgagcgcatccgtcgcaaggtgcctgtgatctgcaacctgaagccgtcgggccagtacgtggccaccgacctgcacaaggcgggcggcatcccgcaggtcatgaagatcctgctgaaggccggactgctgcatggcgactgcctgaccatcacaggccgcacgctggctgaagagctggaacacgtgccggaccagccgcgggccgaccaggacgtgatcatgccaatcgagaaggcgctctatgcggaggggcatctggcgatcctgaagggcaatctcgccgaggaaggcgcggtggccaagatcaccggcctgaagaatccggtcatcaccgggccggcgcgggtgttcgaggatgaacagagcgcgatggaggcgatcctggccgacaagatcaatgcgggggatgtgctggtgctgcgctatcttgggcccaagggcgggcccgggatgccggaaatgctggcgcctacgtcagccattattggcaaggggttgggagagtcggtgggcttcatcaccgatggccggttctccgggggcacctgggggatggtcgtcggccatgtcgcgccggaagcgtatgtaggcggcaatattgcgctcgtgcgggaaggggattcgatcacgatcgatgcgcacaagctggtgttgcaggtgaatgtgtcggatgaggagttggctcgccgccgggctgagtggaaacaacctgttgcgcgttatacacggggggtattggccaagtttgctcgactggcgtcgacggccagtaagggggcggtgacggattga

SEQ ID NO: 344 - protein, 557 aa, Ralstonia eutropha
MAFNKRSRNITQGVARSPNRSMYYALGYQKEDFDKPMVGIANGHSTITPCNAGLQRLADAAIDAVKASDANPQVFGTPTISDGMSMGTEGMKYSLISREVIADCIETAAQGQWMDGVVVIGGCDKNMPGGMIALARTNVPGIYVYGGTIKPGNWKGKDLTIVSSFEAVGEFTAGRMSEEDFEGVERNACPSTGSCGGMYTANTMSSSFEALGMSLLYSSTMANPDQEKVDSAAESARVLVEAIKKDIKPRDIITRKSIENAVALIMATGGSTNAVLHYLAIAHSAEVEWTIDDFERIRRKVPVICNLKPSGQYVATDLHKAGGIPQVMKILLKAGLLHGDCLTITGRTLAEELEHVPDQPRADQDVIMPIEKALYAEGHLAILKGNLAEEGAVAKITGLKNPVITGPARVFEDEQSAMEAILADKINAGDVLVLRYLGPKGGPGMPEMLAPTSAIIGKGLGESVGFITDGRFSGGTWGMVVGHVAPEAYVGGNIALVREGDSITIDAHKLVLQVNVSDEELARRRAEWKQPVARYTRGVLAKFARLASTASKGAVTD

SEQ ID NO: 345 - DNA, 1674 bp, Ralstonia metallidurans
atggcttacaacaaacgttcccagcacatcacgcaaggcgtggcgcgctcccccaaccgttcgatgtactacgcgctcggctacaagaaggaagacttcgacaagccgatggtgggtatcgccaacggccactcgacgatcaccccctgcaacgccggcctgcagcgcctggcggacgcggccgtggatgcgatcaaggcctcggacgccaacccgcagatcttcggcacgccgacgatctccgacggcatgtcgatgggcaccgagggcatgaagtactcgctgatctcgcgtgaagtcattgccgactgcatcgaaaccgctgcccagggccagtggatggacggcgtggtcgtgatcggcggctgcgacaagaacatgcccggcggcatgatcgcactggcgcgcaccaacgtgccgggcatctacgtctacggcggcaccatccgcccgggtaactggaagggcaaggacctgaccatcgtgtcgtcgttcgaggccgtgggcgaattcaccgccggccgcatgagcgaggaagacttcgagggcgtggagaagaacgcctgcccgagcaccggctcgtgcggtggcatgtacaccgccaacacaatgagctcgtcgttcgaggcgctgggcatgtcgctgctgaattcgtcgacgatggccaacccggaccaggaaaaggtggacagcgccgccgaatcggcccgcgtgctggtggaagccatcaagaaggacatcaagccgcgcgacatcatcacgcgcaaatcgatcgagaacgccgtgacgctgatcatggccacgggcggttccaccaacgcggtactgcattacctggccatcgcccactcggccgaagtggaatggaccatcgacgatttcgagcgcatccgccgccgcgtgccggtgatctgcaacctgaagccgtcgggcgcctacgtggccaccgacctgcaccgcgccggtggcattccgcaagtgatgaagatcctgctgaacgccggtctgctgcatggcgactgcctgacgatcacgggccgcacgctggccgaggagctcgagcacgttcccaatgagccgcgtaccgaccaggacgtgatcctgccgatctcgcaggccctgtacaagcaaggccacctggccatcctgaagggcaacctcgccgaggaaggcgcagtggccaaaatcaccggcctgaagaacccggtcatcaccggcccggcccgcgtgttcgaggacgaacagagcgccatggaagcgatcctggcggacaagatcaacgctggcgacatcctggtgctgcgctaccttggcccgaagggcggcccgggcatgcctgaaatgctggcgccgacttcggcgatcatcggcaagggtctcggcgaatcggttggtttcatcaccgacggccgcttctcggggggcacctggggcatggtggttggccacgttgcgccggaagcccatgtgggcggtacgattgcactggttcaggaaggcgactcgatcacgatcgacgcgcaccagctgctgctgcaactgaatgtggccgacgacgagctggcccgccgccgcgctgcctggaaacagccggcgccgcgctacacgcgcggcgtactggcgaagttcgcgaggctggcctccacggccagcaagggcgccgtgacggactga

SEQ ID NO: 346 - protein, 557 aa, Ralstonia metallidurans
MAYNKRSQHITQGVARSPNRSMYYALGYKKEDFDKPMVGIANGHSTITPCNAGLQRLADAAVDAIKASDANPQIFGTPTISDGMSMGTEGMKYSLISREVIADCIETAAQGQWMDGVVVIGGCDKNMPGGMIALARTNVPGIYVYGGTIRPGNWKGKDLTIVSSFEAVGEFTAGRMSEEDFEGVEKNACPSTGSCGGMYTANTMSSSFEALGMSLLNSSTMANPDQEKVDSAAESARVLVEAIKKDIKPRDIITRKSIENAVTLIMATGGSTNAVLHYLAIAHSAEVEWTIDDFERIRRRVPVICNLKPSGAYVATDLHRAGGIPQVMKILLNAGLLHGDCLTITGRTLAEELEHVPNEPRTDQDVILPISQALYKQGHLAILKGNLAEEGAVAKITGLKNPVITGPARVFEDEQSAMEAILADKINAGDILVLRYLGPKGGPGMPEMLAPTSAIIGKGLGESVGFITDGRFSGGTWGMVVGHVAPEAHVGGTIALVQEGDSITIDAHQLLLQLNVADDELARRRAAWKQPAPRYTRGVLAKFARLASTASKGAVTD

SEQ ID NO: 347 - DNA, 1674 bp, Ralstonia solanacearum
atgccagacaacaagcgttcccagcacatcacccagggcgtggcacgctcgcccaaccgctcgatgtactacgcgctgggctaccagaaagaagacttcaacaatccgatgatcggcgtggccaacggccattcgaccatcacgccgtgcaactcgggcctgcagaaactggccgacgcggccgtggccgccgtcaaggcatcgaacgccaacccgcagatcttcggcacgcccaccatttccgacggcatgtcgatgggcaccgagggcatgaagtattcgctgatctcgcgcgaggtcatcgccgactgcatcgagacctgcgcacaaggccagtggatggacggcgtggtcgtgatcggcggctgcgacaagaacatgcccggcggcatgatcgcgctggcacgcaccaacgtgccgggcatctacgtgtacggcggcaccatccggccggggcactggaagggcaaggacctgaccatcgtgtcgtcgttcgaggccgtgggcgagttcaccgccggccgcatgagcgacgaagacttcgagggcatcgagaagaacgcctgcccgtcgagcggctcgtgcggcggcatgtacaccgccaacacgatgagctcgtcgttcgaggcgctgggcatgtcgctgctgtattcgtcgaccatggccaaccccgaccaggagaaggtcgacagcgccgccgaatcggcccgcgtgctggtcgaggccgtgcgccgcgacctcaagccgcgcgacatcatcacgcgcaagtcgatcgagaacgccgtggccgtcatcatggcgaccggcggctcgaccaacgccgtgctgcactacctggccatcgcccatgccgccggcgtggaatggaccatcgatgacttcgagcgcgtgcgccagcgcgtgcccgtgatctgcaacctgaagccgtcgggccagtatgtcgccaccgacctgcaccgcgcgggcggcatcccgcaggtgatgaagatcctgctgaacgcgggcctgctgcacggcgactgcatcaccatcaccggcaagacgctggccgaggaactcgccaacgtgcccgaccagccgcgcgcggaccaggacgtgatcctgccgctcgacaaggcgctctaccagcagggccacctcgccatcctcaagggcaacttggccgaggaaggcgccgtggcgaagatcaccggcctgaagaacccggtcatcaccggcccggcgcgcgtgttcgacgatgagcagagcgcgatggaagccatcctgggcgacaaaatcaacgccggcgacgtgctggtgctgcgctacctcggtccgaagggcggcccgggcatgccggaaatgctggccccgacgtcggccatcatcggcaagggcctgggcgaatcggtcggcttcatcaccgatggacgcttctcgggcggcacctggggcatggtggtcggccacgtcgcgccggaagccttcgtgggcggcaccatcgccctggtgcaggaaggcgattcgatcaccatcgacgcgcaccagcgcgtgctgcagctgaacgtgccggaagacgaactggcccgccgccgcgccgcgtggcagcagccggcaccgcgctatacgcgcggcgtgctcgccaagttcgctcagttggcgtcgacggccagcaagggcgccgtgaccggctga

SEQ ID NO: 348 - protein, 557 aa, Ralstonia solanacearum
MPDNKRSQHITQGVARSPNRSMYYALGYQKEDFNNPMIGVANGHSTITPCNSGLQKLADAAVAAVKASNANPQIFGTPTISDGMSMGTEGMKYSLISREVIADCIETCAQGQWMDGVVVIGGCDKNMPGGMIALARTNVPGIYVYGGTIRPGHWKGKDLTIVSSFEAVGEFTAGRMSDEDFEGIEKNACPSSGSCGGMYTANTMSSSFEALGMSLLYSSTMANPDQEKVDSAAESARVLVEAVRRDLKPRDIITRKSIENAVAVIMATGGSTNAVLHYLAIAHAAGVEWTIDDFERVRQRVPVICNLKPSGQYVATDLHRAGGIPQVMKILLNAGLLHGDCITITGKTLAEELANVPDQPRADQDVILPLDKALYQQGHLAILKGNLAEEGAVAKITGLKNPVITGPARVFDDEQSAMEAILGDKINAGDVLVLRYLGPKGGPGMPEMLAPTSAIIGKGLGESVGFITDGRFSGGTWGMVVGHVAPEAFVGGTIALVQEGDSITIDAHQRVLQLNVPEDELARRRAAWQQPAPRYTRGVLAKFAQLASTASKGAVTG

SEQ ID NO: 349 - DNA, 1674 bp, Ralstonia pickettii
atgccagacaacaagcgttcccagcacatcactcagggcgtggcgcgctcgcccaaccgctcgatgtactacgcgctgggctacacaaaagacgacttcaacaatccgatgatcggtgtggccaacggccattcgaccatcacgccatgcaactcgggcctgcagaagctggccgatgccgccgtggctgcaataaaggacgcccgcgcgaatccgcagatcttcggcacgcccaccatttccgatggcatgtcgatgggcacggaaggcatgaagttctcgctgatctcgcgcgaagtgattgccgactgcatcgagacctgcgtcaacggccaatggatggacggtgtggtcgtcatcggcggctgcgacaagaacatgccgggcggcatgatcgccctggcgcgcacgaatgtgccgggcatctacgtgtacggcggcaccatcaagccggggcactggaagggcaaggacctgaccatcgtctcgtcgttcgaggccgtgggcgaattcaccgccggccgcatgagcgaggaagacttcgagggcatcgaaaaaaacgcctgcccgtcgagcggttcgtgcggcggcatgtacacggccaacacgatgagttcgtcgtttgaagcgctaggcatgtcgttgctgtattcatcgacgatggccaatcccgatcaggagaaggtcgacagcgccgccgaatccgctcgcgtgttggttgatgccgtgcgccgcgacctgaagccgcgcgacatcatcacgcgcaagtccatcgagaacgctgtcgccgtcatcatggcaaccggtggctcgaccaacgccgtgctgcactacctggccatcgctcacgctgcggaagtggaatggacgatcgacgacttcgagcgggtgcgccagcgcgtgcccgtcatctgcaacctcaagccgtcgggccagtacgtggccaccgacctgcacgaggccggcggcatcccgcaggtgatgaagctgctgctcaacgccggcctgctgcatggcgattgcatcaccatcaccggcaagacgctggcggaagaactcgcccacgtgcccgaccagccgcgcgctgatcagaacgtgatcctgccgattgacaaggcgctctacaaggaaggccacctcgccatcctgaagggcaatctggccgaagaaggcgccgtggcgaagatcaccgggctgaagaatcccgtcatcaccggcccggcccgcgtgttcgaggacgagcaaagtgcgatgagcgcgatcctgggcgaccagatcaaggccggcgatattctggtgctgcgctatctggggccgaagggcggccccggcatgccggagatgctggccccgacctcggccatcatcggcaagggcctgggcgagtcagtcggcttcattaccgacggacgcttctcgggcggtacgtggggcatggtggtcggccacgtcgcaccggaagcctacgtgggaggcacgattggattggtgcacgaaggggattcgatcaccatcgacgcgcaccagcggctgctgcaattgaacgtgccggacgacgagcttgcccgccgccgcgccgcgtggaagcaacctgcgccgcgctatacgcgtggcgtgctggcgaagtttgcaaaactggcagcaacggccagcaagggtgcggtaacggactga

SEQ ID NO: 350 - protein, 557 aa, Ralstonia pickettii
MPDNKRSQHITQGVARSPNRSMYYALGYTKDDFNNPMIGVANGHSTITPCNSGLQKLADAAVAAIKDARANPQIFGTPTISDGMSMGTEGMKFSLISREVIADCIETCVNGQWMDGVVVIGGCDKNMPGGMIALARTNVPGIYVYGGTIKPGHWKGKDLTIVSSFEAVGEFTAGRMSEEDFEGIEKNACPSSGSCGGMYTANTMSSSFEALGMSLLYSSTMANPDQEKVDSAAESARVLVDAVRRDLKPRDIITRKSIENAVAVIMATGGSTNAVLHYLAIAHAAEVEWTIDDFERVRQRVPVICNLKPSGQYVATDLHEAGGIPQVMKLLLNAGLLHGDCITITGKTLAEELAHVPDQPRADQNVILPIDKALYKEGHLAILKGNLAEEGAVAKITGLKNPVITGPARVFEDEQSAMSAILGDQIKAGDILVLRYLGPKGGPGMPEMLAPTSAIIGKGLGESVGFITDGRFSGGTWGMVVGHVAPEAYVGGTIGLVHEGDSITIDAHQRLLQLNVPDDELARRRAAWKQPAPRYTRGVLAKFAKLAATASKGAVTD

SEQ ID NO: 351 - DNA, 1689 bp, Limnobacter sp.
atgagcatcaatcgacgttccaagaacattacccagggcgtggcccgttcgcccaaccgcgcgatgtatttcgccatgggttacaaagacgaagacttcaataaccccatgattggcattgccaatggccattccacgatcacgccttgcaacagcggcttgcagcctttggcagatgcggctgtgaaagcagtgaaagaggctggtggcaatccacaaattttcggcacccccaccatctccgatggcatgagcatgggcaccgaaggcatgaagtattcactggtcagccgcgaggtcatcgcggactgcatcgaaactgcggtacagggccagtggatggacggcgtgttggtgatcggcggctgcgacaagaacatgcccggcggcatgatcggcatggcccgcatgaacgtgccaggcatttacgtttatggcggcactatcaagccggggcgttacaaaggcaaagacctgaccattgtgtctgccttcgaagccgtgggcgaattcacggctggccgcatgagcgaggaagacttcaagggtatagagaagaacgcctgcccgagttccggttcctgtggtggcatgtacaccgccaacaccatgagctcggcattcgaagctttgggcatgagcctgccctactccagcaccatgtcgaacattgacgcagagaaagtcacttcaactgaagagtccgctcgcgtcttgatcgaagcggttcgcaacgacttgaagccccgcgacatcatcaccaagaagtcgattgaaaatgctgtggccgtgctgatggccaccggtggttccaccaacgcggtactgcacttcctggccattgcaaaagcagcagatgtggcctggagctacgaagactttgaacgcgtgcgcttgcgcacaccagtcatttgcaacctgaagccttctggccaatacgttgccactgacctgcacgatgccggtggtattccacaagtcatgaaaattttgttggatgcgggcctgttgcatggcgattgcatcaccatcactggcaaaaccattgcagaaaccctggccgatattccttcagtgccccgcgcggatcaaaacgtgatcatgccgatcgaaaaagccctgtacaagcaaggccacttggcgattctgaaaggcaacctggcacccgaaggtgctgtggccaagatcacaggcctcaaaaaccctgtaattaccggaccagccaaggtttttgacgacgagcaaagcgcgatggacgcaattttgggcgacaagatcaaagacggcgacgtgattattcttcgctacttgggccccaaaggcggtccaggcatgccggaaatgttggccccaacctcggcaattattggcaagggcttgggagaaacagtcggcctgatcaccgacggccgcttttccggtggcacctggggtatggtggtcggccacgttgcgccagaggcctacgttggcggcccgatcgcgctgatcaaggaaggtgactccatcacgatggacgcacatcagaaattgttacagatcaacgtgagcgaggaagaactggcgaagcgtcgtgaaagttgggtaaaacccaagccacgctacaccactggtgtgctggccaaattcgcagccttggccagtagcgccagcaagggtgcagtcaccgatggcgatctcgacctctaa

SEQ ID NO: 352 - protein, 562 aa, Limnobacter sp.
MSINRRSKNITQGVARSPNRAMYFAMGYKDEDFNNPMIGIANGHSTITPCNSGLQPLADAAVKAVKEAGGNPQIFGTPTISDGMSMGTEGMKYSLVSREVIADCIETAVQGQWMDGVLVIGGCDKNMPGGMIGMARMNVPGIYVYGGTIKPGRYKGKDLTIVSAFEAVGEFTAGRMSEEDFKGIEKNACPSSGSCGGMYTANTMSSAFEALGMSLPYSSTMSNIDAEKVTSTEESARVLIEAVRNDLKPRDIITKKSIENAVAVLMATGGSTNAVLHFLAIAKAADVAWSYEDFERVRLRTPVICNLKPSGQYVATDLHDAGGIPQVMKILLDAGLLHGDCITITGKTIAETLADIPSVPRADQNVIMPIEKALYKQGHLAILKGNLAPEGAVAKITGLKNPVITGPAKVFDDEQSAMDAILGDKIKDGDVIILRYLGPKGGPGMPEMLAPTSAIIGKGLGETVGLITDGRFSGGTWGMVVGHVAPEAYVGGPIALIKEGDSITMDAHQKLLQINVSEEELAKRRESWVKPKPRYTTGVLAKFAALASSASKGAVTDGDLDL

SEQ ID NO: 353 - DNA, 1674 bp, Herminiimonas arsenicoxydans
atggcattcaatcgccgctcgaaaaacatcacgcaaggcgtgtcccgcagtcctaaccgttccatgtattacgccatgggttacgaaaaggccgatttcgacaagcctatggtcggcatcgccaacggtcactcgacgattacgccatgtaactccggcctgcaaaaactggccgatatcgcgatcaagaccatcaaggatgcaggcggcaatccgcaagtgttcggtacgccgacgatttccgacggcatgtccatgggcaccgaaggcatgaagtattcgctgatttcgcgcgaagtcattgccgactgtatcgaaaccgcagtcaacggccaatggatggatggcgtgctggtcatcggcggctgcgacaagaatatgccgggcggcatgatcgccatgttgcgcaccaacgtgcctagtatttatgtctacggcggcaccatcaagccggggcactggaaaggcaaagacctgaccatcgtttccgcgtttgaagcggtcggcgaattcactgccggccgcatgtcacaagaagattttgacggcatcgaacgcaatgcctgcccatcatccggttcctgcggcggcatgtatacagccaataccatgtcgtcctcgttcgaggcgctgggcctggccttgccttactcgtcgacgatggccaatcctgacgatgaaaaagtcggctccgcagcggaatccgcgcgcgtgctgatcgaagcaatcaagaaggatctgaagccgcgcgacatcgtgacacgcaaggctatcgaaaacgcagtggccgtcatcatggcaaccggcggttcgaccaatgccgtgctgcacttcctggcgattgcgcacgctgcagaaatcgactggaccatcgacgacttcgaacgcatgcgcaaaaaagtccctgtcatctgcgatctgaaaccatccggcaaatacgtggcaaccgatctgcataaggccggcggcattccgcaagtgatgaaggtgttgctcgacgccggcttgttgcacggtgattgcatgacgatcaccggccagaccgttgcagaagcgctggcgcacatcccgtcggtaccaagtgccgaccaggacgtgatccacaccatcgacaaggctttgtacgcacaaggtcaccttgcaatcctgaagggcaatctgtcgcctgaaggttgcgtggcaaaaatcaccggtctgaaaaatcctgtcatcaccggacctgcacgcgtatttgacgacgaatactcggcaatggacgccatcatggcgaaccagatcaaggccggcgacgtactcgtcatgcgctacctcggacctaaaggcggcccgggcatgccggaaatgctggcaccgacttccgcactggtcggtcagggtctgggtgagtcagtcggcttgattaccgatggccgtttctccggcggtacctggggcatggtggttggccacgtttcgccggaagcgtttgtcggcggtaccatcggtctggtggaagaaggcgattccgtcaccatcgatgcgcgtcaattgctgattcagttgaacgtatcggaagaggaaatcgcacgccgtcgcgccaactggaagcagcctgcaccgcgttacacacgtggcgtgctggcaaaatatgcagctctggcatcgacggcaagcaaaggcgctgtcaccggctga

SEQ ID NO: 354 - protein, 557 aa, Herminiimonas arsenicoxydans
MAFNRRSKNITQGVSRSPNRSMYYAMGYEKADFDKPMVGIANGHSTITPCNSGLQKLADIAIKTIKDAGGNPQVFGTPTISDGMSMGTEGMKYSLISREVIADCIETAVNGQWMDGVLVIGGCDKNMPGGMIAMLRTNVPSIYVYGGTIKPGHWKGKDLTIVSAFEAVGEFTAGRMSQEDFDGIERNACPSSGSCGGMYTANTMSSSFEALGLALPYSSTMANPDDEKVGSAAESARVLIEAIKKDLKPRDIVTRKAIENAVAVIMATGGSTNAVLHFLAIAHAAEIDWTIDDFERMRKKVPVICDLKPSGKYVATDLHKAGGIPQVMKVLLDAGLLHGDCMTITGQTVAEALAHIPSVPSADQDVIHTIDKALYAQGHLAILKGNLSPEGCVAKITGLKNPVITGPARVFDDEYSAMDAIMANQIKAGDVLVMRYLGPKGGPGMPEMLAPTSALVGQGLGESVGLITDGRFSGGTWGMVVGHVSPEAFVGGTIGLVEEGDSVTIDARQLLIQLNVSEEEIARRRANWKQPAPRYTRGVLAKYAALASTASKGAVTG

SEQ ID NO: 355 - DNA, 1785 bp, Bordetella parapertussis
atgtccgataataaccggcgagcgtgttgttccgtagcgctgccttccgacagcgatctggccggcccggcatgggcctacgcacctggagacaagaccatgtccgacaacaatcgttcccgtcacattaccgagggcgtggcgcgcgcgcccaatcgggccatgtactacgcgctgggctacaccgaggcggatttccagaatccgatgatcggcgtggccaacggacattccacgatcactccatgcaacagcgggctgcagcgcctggccgacgcggcgatcgaggccatccgcgtctcccgcgccaacccccaggtgttcggcacgccgacgatttccgatggcatgtccatgggcaccgaaggaatgaagtattcgctggtgttgcgcgaggtcatcgccgactgcatcgagaccgccgcgcaggggcagtggatggatggcgtggtggtcatcggcggatgcgacaagaacatgcccggcggcatgatggcgctcgcgcgcatgaatgtgcccggcatctacgtgtatggcggcaccatcaagcccggccactacaagggcaaggacctgaccatcgtatcggtgttcgaagccgtcggcgaatacaccatgggccgcatggacgaaaccgacttcaaggccatcgagcaatgcgccatccccgggtcgggttcctgcggcggcatgtacacggccaacaccatgagctcggccttcgaggccatggggatgagcctgcctcattccagcaccatggccaacgaggaccaggagaaagtcgcgtcggcggcggaatcggcgcgcgtgctggtcgaggcggtgcggcgccagctgcggccgcgcgacatcatcacccgcgcttccatcgagaacgccgtggcggtgatcatggccacgggcggctcgaccaacgccgtgctgcacttcctcgccatcgcccacgcggcggaagtgccgtggaacatcgacgacttcgagcgcatccgcaagcgcgtgccggtcatctgcgatctcaagccgtccggcaagtacgtggcgaccgacctgcatcgcgccggcggcatcccacaagtgatgaagatcctgctgaacgccggcctgttgcatggcgattgcatcaccatcaccggcaagaccgtggccgagacgctggcgaacgtacccgatgcgccgccgcccgggcaggacgtcatcatgcccatcgaacgcgcgttctacccgcaggggcacctggcgatactcaagggcaatctttcgccggaaggctgcgtggccaagatcaccgggttgaagaatccggtcattaccggcccggcgcgcgtgttcgattccgaagacgatgccatgtccgccatcatggaccgccgcatccgcgatggcgatgtggtggtgatccgctacgagggccccaagggcggtccaggcatgcgcgagatgctcgcgcccacttccgcgctggtcggccaggggttgggcgaaaccgtcggcctgatcaccgacgggcggttttccggcggcacctggggcatggtggtcgggcacgtggcgcccgaggcgttcgtcggcgggccgatcgcgctgattcgcgagggcgattcggttaccatcgatgcccatcagctgctgctgcagctcaacatcagcgatgaggaaatggcggctcgtcgcaaggcttgggcccagcccaagccgcgctatgtgcgcggcgtgcttgccaagttcggcaagctggcctgtaccgccagccgtggggcagtaaccgatgcatttgaagagtag

SEQ ID NO: 356 - protein, 594 aa, Bordetella parapertussis
MSDNNRRACCSVALPSDSDLAGPAWAYAPGDKTMSDNNRSRHITEGVARAPNRAMYYALGYTEADFQNPMIGVANGHSTITPCNSGLQRLADAAIEAIRVSRANPQVFGTPTISDGMSMGTEGMKYSLVLREVIADCIETAAQGQWMDGVVVIGGCDKNMPGGMMALARMNVPGIYVYGGTIKPGHYKGKDLTIVSVFEAVGEYTMGRMDETDFKAIEQCAIPGSGSCGGMYTANTMSSAFEAMGMSLPHSSTMANEDQEKVASAAESARVLVEAVRRQLRPRDIITRASIENAVAVIMATGGSTNAVLHFLAIAHAAEVPWNIDDFERIRKRVPVICDLKPSGKYVATDLHRAGGIPQVMKILLNAGLLHGDCITITGKTVAETLANVPDAPPPGQDVIMPIERAFYPQGHLAILKGNLSPEGCVAKITGLKNPVITGPARVFDSEDDAMSAIMDRRIRDGDVVVIRYEGPKGGPGMREMLAPTSALVGQGLGETVGLITDGRFSGGTWGMVVGHVAPEAFVGGPIALIREGDSVTIDAHQLLLQLNISDEEMAARRKAWAQPKPRYVRGVLAKFGKLACTASRGAVTDAFEE

SEQ ID NO: 357 - DNA, 1686 bp, Bordetella petrii
atgcccagcaacgaacgttcacgccacatcacgcaaggcgtcgcccgcgcgcccaaccgggccatgtattacgcgctgggctaccaggaagccgatttcgacaaccccatgatcggcgtggccaacggccattccaccatcaccccctgcaacagcggcctgcagcggctggccgacgcggccatcgatgccgtgcgcgcggcccgcgccaatccgcaggtgttcggcacccccaccatatccgacggcatgtcgatgggcaccgagggcatgaaatactcgctggtgtcgcgcgaagtcattgccgactgtatcgagaccgccgtgcagggccagtggatggacggcgtcgtggtcatcggcggctgcgacaagaacatgcccggcggcatgatcgcgctggcccgcatgaacgtgccaggcatctacgtgtatggcggcaccatcaagccgggccgctataaagggcaagatctcactatcgtgtccgtgttcgaagccgtcggtgagtacaccatggggcgcatggacggcgaagatttccgccagatcgaaaaatgcgccattcccggctcgggctcgtgcggcggcatgtacaccgccaacaccatgagttcggccttcgaagccatgggcatgagcctgccgtattccagcaccatggccaacgaagacgacgaaaaaatcgcctcggccgccgagtccgcccgcgtgctggtcgatgccgtgcggcgcgacgtgcggccgcgcgacatcatcacgcgcgaatccatcgaaaacgccgtgtcggtcatcatggccacgggcggctccaccaatgccgtgctccatttcctggccatcgcccacgccgccgaagttcaatggaccatcgacgacttcgagcgcatccgccggcgcgtgccggtcatctgcgacctcaaaccttcgggccgatacgtggccaccgatctgcaccgcgccggcggcgtcccgcaagtcatgaagctgctgctcgctgccggcttgctgcatgggcattgcatgaccatcaccggcaagaccatcgccgaaacgctcgccgacgtgcccgccgagccgccggccggccaggatgtcatccggcctatcggccgcgcgctgtacccgcagggccatctggccatcctcaagggcaacctgtcgcccgagggctgcgtggccaagatcacgggcctgaagaatcccgtcatcaccggcccggcgcgcgtgttcgattcagaagacgacgccatggccgccatcatggaacggcgcattcgcgctggcgacgtggtggtcatccgctacgaagggcccaagggcggtcccggcatgcgcgaaatgctggcgcccacctcggcgctggtggggcagggcctgggcgaaagcgtcggcctcattaccgatggccgcttctcgggcggcacctggggcatggtcgtgggccatgtcgcgcccgaggcctatgtgggcggccccattgccctgatccgcgaaggcgattcggttaccatcgacgctcaccaattgttgttgcagctcaatatttctgacgacgaaatggcggcgcgccgcaaggcctgggtccagccccggccgcggtacacgcgcggcgtgcttgccaagttcggcaagctggccggcaccgccagtcgcggggcagttaccgatgcatttgaagcatag

SEQ ID NO: 358 - protein, 561 aa, Bordetella petrii
MPSNERSRHITQGVARAPNRAMYYALGYQEADFDNPMIGVANGHSTITPCNSGLQRLADAAIDAVRAARANPQVFGTPTISDGMSMGTEGMKYSLVSREVIADCIETAVQGQWMDGVVVIGGCDKNMPGGMIALARMNVPGIYVYGGTIKPGRYKGQDLTIVSVFEAVGEYTMGRMDGEDFRQIEKCAIPGSGSCGGMYTANTMSSAFEAMGMSLPYSSTMANEDDEKIASAAESARVLVDAVRRDVRPRDIITRESIENAVSVIMATGGSTNAVLHFLAIAHAAEVQWTIDDFERIRRRVPVICDLKPSGRYVATDLHRAGGVPQVMKLLLAAGLLHGHCMTITGKTIAETLADVPAEPPAGQDVIRPIGRALYPQGHLAILKGNLSPEGCVAKITGLKNPVITGPARVFDSEDDAMAAIMERRIRAGDVVVIRYEGPKGGPGMREMLAPTSALVGQGLGESVGLITDGRFSGGTWGMVVGHVAPEAYVGGPIALIREGDSVTIDAHQLLLQLNISDDEMAARRKAWVQPRPRYTRGVLAKFGKLAGTASRGAVTDAFEA

SEQ ID NO: 359 - DNA, 1695 bp, Polaromonas sp.
atggaaaccaagaccattcagctcaacccccgcagcaaaaacatcaccgaaggcaaatcgcgcgcgcccaaccgctcgatgtactacgccatgggctatgaagaggccgacttcaagaagcccatgattggtgtggccaacgggcacagcaccatcaccccctgcaacagcggcctgcaaaagctggcggacgcggccattgccggcattgaagaagccggcggcaacgcccaggtgttcggcacgcccaccatctcggacggcatggccatgggcaccgagggcatgaagtactcgctggtcagccgcgaagtgatctccgactgcatcgaaacctgcgtgcagggccagtggatggacggcgtgctggtgatcggcggctgcgacaagaacatgcccggcggcctgatgggcatgctgcgcgccaacgtgccggccatctacgtctatggcggtaccattttgccgggcagctacaagggcaaagacctcaacatcgtcagcgtgtttgaagccgtcggcgaaaacgcagcaggccgcatgagcgatgaagacctgctgcaaatcgagcgccgcgccattcccggcaccggtagctgcggcggcatgtacacggccaacaccatgtccagcgccttcgaggcgctcggcatttcgctgccctactccagcaccatggccaatccgcacgacgagaaaatgaactcggccagggagtccgccaaggtcctggtcgaagccatcaagaaagacatcaagccgcgcgatctcgtcacgaagaaagccattgaaaacgccgtggcagtgatcatggccacgggcggctccaccaatgccgtgctgcacttcctggcgattgcgcatgccgccggcgtggactggacaatcgacgacttcgaacgcgtgcgccaaagaacgccggtgctgtgcgacctgaagccgtccggcaagtacctggccgtggacctgcaccgcgccggcggcattccgcaggtcatgaagatgctgctggcggccggcctgctgcatggcgactgcctgacgatcaccggccaaaccattgccgaggtgctgaaggatgtgcccgaagcgccgcgcgccgaccaggacgtgattcgccccatcagcaaccccatgtacgcccagggccacctggccatcctgaagggcaacctctcgcctgaaggctgcgtggccaaaatcaccggcctgaaaaacccggtcatgacgggcccggcccgcgtatttgacgacgagcagtcggcgctggccgccatcctggccggcaagatcaaggcgggcgacgtgatggtgctgcgttacctcggccccaagggcggtcccggcatgcctgaaatgctggcgcctaccggtgcgctgattggcgccggcctgggcgaaagcgtgggcctgatcaccgacggccgcttctccggcggcacctggggcatggtagtcggccatgtggcccccgaagcggccgccggcggcaatatcgcattcatcaacgaaggcgactccatcaccattgactcaaaacagttgctgctgcaactgaacatcagcgacgcggagctggaaaaacgcaaggtcggctggaaagcaccggcaccgcgctacaaccgcggcgtgcaggccaagtttgccttcaacgcgtcgagtgccagcaagggtgcggtgctggacgactattga

SEQ ID NO: 360 - protein, 564 aa, Polaromonas sp.
METKTIQLNPRSKNITEGKSRAPNRSMYYAMGYEEADFKKPMIGVANGHSTITPCNSGLQKLADAAIAGIEEAGGNAQVFGTPTISDGMAMGTEGMKYSLVSREVISDCIETCVQGQWMDGVLVIGGCDKNMPGGLMGMLRANVPAIYVYGGTILPGSYKGKDLNIVSVFEAVGENAAGRMSDEDLLQIERRAIPGTGSCGGMYTANTMSSAFEALGISLPYSSTMANPHDEKMNSARESAKVLVEAIKKDIKPRDLVTKKAIENAVAVIMATGGSTNAVLHFLAIAHAAGVDWTIDDFERVRQRTPVLCDLKPSGKYLAVDLHRAGGIPQVMKMLLAAGLLHGDCLTITGQTIAEVLKDVPEAPRADQDVIRPISNPMYAQGHLAILKGNLSPEGCVAKITGLKNPVMTGPARVFDDEQSALAAILAGKIKAGDVMVLRYLGPKGGPGMPEMLAPTGALIGAGLGESVGLITDGRFSGGTWGMVVGHVAPEAAAGGNIAFINEGDSITIDSKQLLLQLNISDAELEKRKVGWKAPAPRYNRGVQAKFAFNASSASKGAVLDDY

SEQ ID NO: 361 - DNA, 1695 bp, Polaromonas naphthalenivorans
atggaaaccaaagtcatcgccatcaaccgccgctcggccaacatcaccgagggcaagtcgcgcgcgcccaaccgctccatgtactacgccatgggctacgaggaaagcgatttcaagaaacccatgatcggcgtggccaacggccacagcaccatcacgccgtgcaacagcggcctgcaaaagctggcggacgcggcgattgacgcgattgaggaagccggcggcaatgcgcaggtgttcggcacgccgacgatttcggacggcatggccatgggcaccgaaggcatgaagtattcgctggtcagccgcgaagtcatttcggactgcatcgaaacctgcgtgcagggccagtggatggacggcgtgctggtggtcggcggctgcgacaagaacatgcccggcggcctgatgggcatgctgcgcgccaacgtgccggcgatttttgtctatggcggcacgatcttgccaggccattaccagggcaaagacctgaacatcgtcagcgtgttcgaagccgtcggtgaaaacgccgccggccgcatgagcgacgaagacctgctgcagattgagcgtcgcgccattcccggcaccggcagctgcggcggcatgtacaccgccaacaccatgtccagcgccttcgaggccctgggcatttcgctgccctactccagcaccatggccaatccgcatgacgaaaagctgaactcggcgaaggaatcggcccgggtgctgatcgaagcggtcaagaaagacatcaagccgcgcgacatcgtcaccaagaaatccattgaaaacgccgtggccgtcatcatggccaccggcggctcgaccaatgccgtgctgcatttcctggccatcgcccatgcggccggcgtcgaatggacgattgacgacttcgagcgcgtgcgccagaaaaccccggtgctgtgcaacctgaaaccctcgggccagtacctggcggtggacctgcaccaggccggcggcattccgcaggtcatgaaaatgctgctggtcgccggcctgctgcatggcgactgcatcaccatttcgggccagaccattgccgaagtgcttgcggacgtgcccgatgcgccgcgcgccggccaggacgtgatccgccccatcgaccagccgatgtatgcgcagggccacctggccatcctcaagggcaacctctcgcccgaaggctgcgtggccaagatcaccggcttgaagaacccggtcatgaccggcccggcccgggtgtttgaggacgagcagtccggcctgaaggcgattctggacggcaagatcgtggccggtgacgtgatggtgctgcgctacctcggccccaagggcggtcccggcatgcctgaaatgctggccccgaccggcgcgctgattggcgccggcctgggcgagagcgtcggcctgatcaccgacgggcgcttttccggcggcacctggggcatggtggtcggccatgtggcgccggaagcggcggccggcggcaatatcgccttcatcgaggaaggcgactcgatcacgattgacgccaatcagctgctgctgcaactgaacatcagcgacgccgagcttgaaagccgcaaggtcggctggacggccccggccccgcgttacacccgtggcgtgcaggccaagttcgccttcaatgcctccagcgccagcaagggcgcggtgcttgatgactattga

SEQ ID NO: 362 - protein, 564 aa, Polaromonas naphthalenivorans
METKVIAINRRSANITEGKSRAPNRSMYYAMGYEESDFKKPMIGVANGHSTITPCNSGLQKLADAAIDAIEEAGGNAQVFGTPTISDGMAMGTEGMKYSLVSREVISDCIETCVQGQWMDGVLVVGGCDKNMPGGLMGMLRANVPAIFVYGGTILPGHYQGKDLNIVSVFEAVGENAAGRMSDEDLLQIERRAIPGTGSCGGMYTANTMSSAFEALGISLPYSSTMANPHDEKLNSAKESARVLIEAVKKDIKPRDIVTKKSIENAVAVIMATGGSTNAVLHFLAIAHAAGVEWTIDDFERVRQKTPVLCNLKPSGQYLAVDLHQAGGIPQVMKMLLVAGLLHGDCITISGQTIAEVLADVPDAPRAGQDVIRPIDQPMYAQGHLAILKGNLSPEGCVAKITGLKNPVMTGPARVFEDEQSGLKAILDGKIVAGDVMVLRYLGPKGGPGMPEMLAPTGALIGAGLGESVGLITDGRFSGGTWGMVVGHVAPEAAAGGNIAFIEEGDSITIDANQLLLQLNISDAELESRKVGWTAPAPRYTRGVQAKFAFNASSASKGAVLDDY

SEQ ID NO: 363 - DNA, 1695 bp, Rhodoferax ferrireducens
atggacatcaaaccagtcatcctgaacccacgcagcaaaaacatcaccgagggcaaatcgcgggcgcccaatcgctccatgtactacgccatgggctacgaggccgacgacttcaagaagcccatgatcggtgtcgccaacggccacagcaccatcacaccgtgcaactccggcctgcaaaagctggccgatgccgccattgccgcgattgaagaagccggcggcaacgcccaggtgttcggcacccccaccatttccgacggcatgtcgatgggcaccgagggcatgaagtattcgctggtcagccgcgaagtaatttccgactgtattgagacctgcgtgcagggccagtggatggacggtgtgctggtgatcggcggttgcgacaaaaacatgcccggcggcctgatgggcatgctgcgcgccaatgtgcccgcgatttatgtctacggcggcaccattttgccgggccattacaagggccaggacctcaacatcgtgagcgtgttcgaggccgtgggcgagaacgccgcaggtcgcatgagcgacgaagatctgttggagattgagcgccgcgccatccctggccccggctcttgcggcggcatgtacaccgccaacaccatgagttcggcctttgaggcactgggcatctccctggtctactcgtccaccatggccaatccgcatgacgagaagctgaattcggcccaagaatcagccaaggtgctgattgaagccatcaagaacgacctgaagccgcgtgacatcgtgacccgcaaatcgattgagaacgcgattgccgttgtgatggcgattggcggctcgaccaacgcggtgctgcatttcctggcgattgcccatgccgcaggcgtggagtggacgattgacgactttgagcgtgtacgccaaaaaaccccggtgttgtgcgacctcaaaccgagcggcaagtacctggcggtggacctgcaccgcgccggtggcattccgcaagtgatgaagatgctgctaagcgctggcctgctgcacggcgactgcatcaccatcaccggccagaccgtggctgaagtgttgaaagacgtgccggatgcaccacgggcagaccaaaacgtgattcggccgatgaacaaaccgatgtatgcccagggccatctggccattctgaagggcaacctggccccggaaggctgcgtcgccaagatcaccggcctgaaaaacccggtcatgaccggcccggcacgcgtctttgaggacgaacaatcggccttggccgcgattctggccaacaagattgtggccggcgatgtcatggtgctgcgctacctcggccccaaaggcggccccggcatgcccgaaatgctggccccgaccggcgcgctggtcggccagggtttgggcgaatcagtcggcctgatcaccgacggccgtttctccggtggcacctggggcatggtggtcggtcacgtggcaccggaagcggctgccggcggcctgattgctttgattgaagaaggcgactcgatcaccatcgacgcgcaccagttgctgctgcaactcaacgtcagcgacgacatcattgccaaacgccgtagcgtgtggacggccccgcagccgcgctacacacgcggcgtgcaggccaagtttgcctttaacgcatccaccgccagcaagggtgcggtgctggacaactactga

SEQ ID NO: 364 - protein, 564 aa, Rhodoferax ferrireducens
MDIKPVILNPRSKNITEGKSRAPNRSMYYAMGYEADDFKKPMIGVANGHSTITPCNSGLQKLADAAIAAIEEAGGNAQVFGTPTISDGMSMGTEGMKYSLVSREVISDCIETCVQGQWMDGVLVIGGCDKNMPGGLMGMLRANVPAIYVYGGTILPGHYKGQDLNIVSVFEAVGENAAGRMSDEDLLEIERRAIPGPGSCGGMYTANTMSSAFEALGISLVYSSTMANPHDEKLNSAQESAKVLIEAIKNDLKPRDIVTRKSIENAIAVVMAIGGSTNAVLHFLAIAHAAGVEWTIDDFERVRQKTPVLCDLKPSGKYLAVDLHRAGGIPQVMKMLLSAGLLHGDCITITGQTVAEVLKDVPDAPRADQNVIRPMNKPMYAQGHLAILKGNLAPEGCVAKITGLKNPVMTGPARVFEDEQSALAAILANKIVAGDVMVLRYLGPKGGPGMPEMLAPTGALVGQGLGESVGLITDGRFSGGTWGMVVGHVAPEAAAGGLIALIEEGDSITIDAHQLLLQLNVSDDIIAKRRSVWTAPQPRYTRGVQAKFAFNASTASKGAVLDNY

SEQ ID NO: 365 - DNA, 1707 bp, Verminephrobacter eiseniae
atggcagacaacaagacgaccacgatcgagcctatcaaccgccgcagcgcgaacatcacacagggcaagtcgcgcgcacccaaccgctccatgtactacgccatgggctacgtggagggcgacttcgtcaagccgatggtcggcgtggccaatggccacagcaccatcacgccttgcaacagcgggctgcaaaaactgaccgatgccgccatcgagggcatcgaggaggccggcggcaatgcccaggtgttcggcacgccgaccatctcggacggcatggccatgggcaccgaaggcatgaagtacagcctggtcagccgtgaagtcatcagcgactgcatagaaacctgcgtcagcggccagtggctggacggcgtgctggtggtcggcggctgcgacaaaaacatgcccggcggcctgatgggcatgttgcgcgccaacgtgcccgcaatctatgtgtacggcggcaccatcctgcccggccactaccaggggcgggaactgaatatcgtcagcgtgttcgaggcggtgggcgaaaacgccgccggcaagctgagcgaccacgacctcagggagatcgaaaagcgcgccatccccggcaccggctcctgcggcggcatgtataccgccaacaccatgtccagcgcgttcgaggccctgggcatcagcctgccctactcgtcgaccatggccaacccgcatgacgagaagacgaactcggccaaggcatcggccaaggtgctgatcgaggccatccgcaacgacctcaagccgcgcgacatcgtgaccaggaaggccatcgagaatgcagtggccgtgatcatggccaccggcggctcgaccaacgccgtgctgcatttcctggcgatcgcccatgcggcaggcgtgccgtggagcatcgacgacttcgagcgcgtgcgccagaagacccccgtgctgtgcgacctcaagcccagcggcaaatacctggccgtggacctgcaccgcgcgggcggcatcccgcaggtgatgaagctgctgctcaacgccggcctgctgcatggcgactgcatcaccatcgagggcaagacgatggcccaagtgctcaaggatgtgcccgatcggccgcgcgcagaccagaacgtgatccgccccatcgaccagcccctgtacgcgcagggccacctggccatcctcaagggcaacctcagccccgaaggggccgtggccaagatcaccggcctgaagaacccggtcatcaccggcccggcgcgcgtgttcgacgacgagcaatctgcgctgcaggcgatactggacggcaagatccaggccggcgacgtgatggtgctgcgctacctggggcccaagggcggccccggcatgcctgaaatgctggcccccaccggcgcgctgatcggcgccggcctgggagaaagcgtgggcctgatcaccgacgggcgcttttccggcggcacctggggcatggtcgtcggccatgtggcgcccgaggccgccgcaggcggcaccatcgctttcgtgcatgaaggcgacagcatcaccatcgacgcccgccaactgctgctgcaattgaatgtggctgaggcagaaatcgcccggcgccgtgcccggtggacggcccccgctgcgcgctacacacgcggcgtgcaggccaagttcgccttcaacgcatcgagcgccagccaaggcgcggtgctcgacgcatactga

SEQ ID NO: 366 - protein, 568 aa, Verminephrobacter eiseniae
MADNKTTTIEPINRRSANITQGKSRAPNRSMYYAMGYVEGDFVKPMVGVANGHSTITPCNSGLQKLTDAAIEGIEEAGGNAQVFGTPTISDGMAMGTEGMKYSLVSREVISDCIETCVSGQWLDGVLVVGGCDKNMPGGLMGMLRANVPAIYVYGGTILPGHYQGRELNIVSVFEAVGENAAGKLSDHDLREIEKRAIPGTGSCGGMYTANTMSSAFEALGISLPYSSTMANPHDEKTNSAKASAKVLIEAIRNDLKPRDIVTRKAIENAVAVIMATGGSTNAVLHFLAIAHAAGVPWSIDDFERVRQKTPVLCDLKPSGKYLAVDLHRAGGIPQVMKLLLNAGLLHGDCITIEGKTMAQVLKDVPDRPRADQNVIRPIDQPLYAQGHLAILKGNLSPEGAVAKITGLKNPVITGPARVFDDEQSALQAILDGKIQAGDVMVLRYLGPKGGPGMPEMLAPTGALIGAGLGESVGLITDGRFSGGTWGMVVGHVAPEAAAGGTIAFVHEGDSITIDARQLLLQLNVAEAEIARRRARWTAPAARYTRGVQAKFAFNASSASQGAVLDAY

SEQ ID NO: 367 - DNA, 1695 bp, Acidovorax sp.
atgaccgacccgctgccgctgaaccgccgctccgcccacatcacccagggcaaggcgcgcgcgcccaaccgctccatgttctacggcatgggctaccaagagggtgacttcgccaagcccatggtgggcgtggccaacgggcacagcaccatcacgccctgcaacagcggcctgcaacgcctggccgacgcggccatcgcaggcatcgaggaagcgggcggcaacgcccaggtcttcggcacgcccaccatcagcgacggcatggccatgggtaccgagggcatgaagtacagcctggtgagccgcgaggtgattgccgactgcgtcgagacctgcgtgcagggccagtggatggacggcgtggtcgtcatcggcggctgcgacaagaacatgcccggcggcctgatgggcatgctgcgcgccaacgtgccggccatctacgtgtatggcggcaccatcctgccgggccgctggcaggggcaagacctgaacatcgtgagcgtgttcgaagccgtgggccagaacgccgcgggcaggatgaccgaccaggagctgaaggacatcgagcagcacgccatcccgggcacgggctcgtgcggcggcatgtacacggccaacaccatgtcctcggccttcgaggcgctgggcatgagcctgccctactcctccaccatggccaatccgcacgacgagaaaatgaactcggcccgcgaatccgcccgggtgctgatcgaggccatccgcaaggacttgaagccacgcgacatcgtcacgcgcaaggccatcgagaacgccgtggccgtgatcatggccacgggcggctccaccaacgcggtgctgcacttcctggcgatcgcgcacgcggcgggtgtggagtggtccatcgacgacttcgagcgcatgcgcaagaaggtcccagtgatctgcgacctcaagcccagcggccggtacctggccgtcgacctgcaccgcgcgggcggcattccccaggtgatgaaggtgctgctgaacgccggcctgttgcacggcgactgcatgaccatcaccggtaaaaccatcgccgaaaccctggccgacgtacccgacgcgccacggccggaccaggacgtgattcgcccgatcgacaaggcgctgtaccgcgaggggcacctcgccatcctcaagggcaacctgagtcccgagggcgccgtggccaagatcaccgggctgaagaaccccgtcatcaccgggcccgcgcgtgtgttcgacgacgagcagtcggcgctgcaggccatcctggacggcaggatcgtcgcgggcgacgtgatggtgttgcgctacctcggccccaagggtggcccgggcatgccggagatgctggcccccacgggcgcgctgatcggtgcgggcctgggcgagagcgtgggcctgatcaccgacgggcgcttctcgggcggcacctggggcatggtggtgggccacgtcgcgcccgaggccgctgcggggggcactattgcgctggtgcatgagggcgacacgatcaccatcgacgcccaccaactgctgctgcaactgcacgtggacgacgccacgctggcacagcgccgcgccgcctggcagccacccacgccgcgctacatgcggggcgtgcaggccaagtttgccttcaacgcctccagcgccagcaagggtgcggtgctggatgacttttcatga

SEQ ID NO: 368 - protein, 564 aa, Acidovorax sp.
MTDPLPLNRRSAHITQGKARAPNRSMFYGMGYQEGDFAKPMVGVANGHSTITPCNSGLQRLADAAIAGIEEAGGNAQVFGTPTISDGMAMGTEGMKYSLVSREVIADCVETCVQGQWMDGVVVIGGCDKNMPGGLMGMLRANVPAIYVYGGTILPGRWQGQDLNIVSVFEAVGQNAAGRMTDQELKDIEQHAIPGTGSCGGMYTANTMSSAFEALGMSLPYSSTMANPHDEKMNSARESARVLIEAIRKDLKPRDIVTRKAIENAVAVIMATGGSTNAVLHFLAIAHAAGVEWSIDDFERMRKKVPVICDLKPSGRYLAVDLHRAGGIPQVMKVLLNAGLLHGDCMTITGKTIAETLADVPDAPRPDQDVIRPIDKALYREGHLAILKGNLSPEGAVAKITGLKNPVITGPARVFDDEQSALQAILDGRIVAGDVMVLRYLGPKGGPGMPEMLAPTGALIGAGLGESVGLITDGRFSGGTWGMVVGHVAPEAAAGGTIALVHEGDTITIDAHQLLLQLHVDDATLAQRRAAWQPPTPRYMRGVQAKFAFNASSASKGAVLDDFS

SEQ ID NO: 369 - DNA, 1695 bp, Delftia acidovorans
atgaccccgccgaaccagatcaaccgccgaagctcccacatcaccgaaggcaaggcgcgcgcagccaaccgctccatgttctacggcatgggctacaaggaagaggatttcaagaagcccatggtcggcgtggccaacggccacagcacgatcacgccgtgcaactccggcctgcaaaggctggcggacgcggccatcgcaggcatcgaggaagccggcggcaacgcgcaggtgttcggcacgccgaccatctcggacggcatgtccatgggcacggaaggcatgaagtactcgctggtcagccgcgaggtgatcgccgactgcatagagacctgcgtgggcggccagtggatggacggcgtgctagtggtcggcggctgcgacaagaacatgccgggcggcatgatgggcatgctgcgcgccaatgtgccggccatctacgtctacggcggcaccatcctgcccggcaggtggaaaggccgggacctgaacatcgtcagcgtgttcgaggccgtcggcgaaaacgccgcgggaaagatcagcgaccaggagctcaaggacatcgagcagcacgccattcccggcacgggctcgtgcggcggcatgtacaccgccaacaccatgtcgagcgcgttcgaggcgctgggcatgagcctgccctactcctccaccatggccaatccccatgatgaaaaggaaaactcggccaaggaatccgccagggtgctgatcgaggccatcaagatggacctcaagccgcgcgatatcgtgacgcgcaagtccatcgagaacgcggtctcggtgatcatggcgaccgggggctccaccaatgccgtgctgcactttcttgcgatcgcccatgcggccggcgtgccctggtccatcgacgacttcgagcgcatccgccagcgggtgccggtgctgtgcgatctcaagcccagcggcagatacctggcggtggacctgcaccaggcgggcggcatcccgcaggtcatgaagatcctgctgaatgcgggcctgctgcacggcgactgcatcaccatctcgggccagaccattgcgcagaccctggctggcgtgcctgacgaaccaccgaacccgcagatcatccgccccctctcggatgcactctatccgcagggccacctggccattctcaagggcaacctgagcccggaaggcgcggtggccaagatcacgggcctgaagaacccggtcatcaccggcccggcacgcgtgttcgacgatgagcaatcggcactggcggccatcctcgacggcaggatacaggccggcgatgtgatggtgctgcgctacctgggccccaagggcggccccggcatgccggaaatgctggcccccacgggcgccctgatcggcgccggcctgggcgagagcgtgggcctgatcaccgatggccgcttctccggcggcacctggggcatggtggtcggccacgtggcgccggaagcggccgtgggcggcaccatcgcgctggtgcacgagggcgactcgatcaccatcgacgcgcacgcattgcggctgcagctgaacgtgcccgaagacgtgctcgcccagcgccgcgcggcatggaaggcccccgcgccccgctacacgcggggcgtgcaggccaagttcgctttcaacgcatcgagcgccagctcgggcgcggtgctggacaacttcgccatctga

SEQ ID NO: 370 - protein, 564 aa, Delftia acidovorans
MTPPNQINRRSSHITEGKARAANRSMFYGMGYKEEDFKKPMVGVANGHSTITPCNSGLQRLADAAIAGIEEAGGNAQVFGTPTISDGMSMGTEGMKYSLVSREVIADCIETCVGGQWMDGVLVVGGCDKNMPGGMMGMLRANVPAIYVYGGTILPGRWKGRDLNIVSVFEAVGENAAGKISDQELKDIEQHAIPGTGSCGGMYTANTMSSAFEALGMSLPYSSTMANPHDEKENSAKESARVLIEAIKMDLKPRDIVTRKSIENAVSVIMATGGSTNAVLHFLAIAHAAGVPWSIDDFERIRQRVPVLCDLKPSGRYLAVDLHQAGGIPQVMKILLNAGLLHGDCITISGQTIAQTLAGVPDEPPNPQIIRPLSDALYPQGHLAILKGNLSPEGAVAKITGLKNPVITGPARVFDDEQSALAAILDGRIQAGDVMVLRYLGPKGGPGMPEMLAPTGALIGAGLGESVGLITDGRFSGGTWGMVVGHVAPEAAVGGTIALVHEGDSITIDAHALRLQLNVPEDVLAQRRAAWKAPAPRYTRGVQAKFAFNASSASSGAVLDNFAI

SEQ ID NO: 371 - DNA, 1683 bp, Methylibium petroleiphilum
atgagcatcaaccgccgttcgaagaacatcaccgaaggcgtggcccgcgcacccaaccgctcgatgtactacgcgatgggctaccaggaggccgacttcaagaagccgatgatcggcgtggcgaacggccactcgaccatcacgccctgcaactcgggcctgcagaagctggccgacgccgcggtcgagggcatcgaggcggccggcggcaatgcacagatcttcggcacccccaccatcagcgacggcatggcgatgggcaccgagggcatgaagtactcgctggtctcgcgcgaggtcatcgccgactgcgtggaaacctgcgtcggcggccagtggatggacggcgtgctggtggtcggcggctgcgacaagaacatgccgggcggcatgatgggcatgctgcgcgccaacgtgcccgcgatctacgtctacggcggcaccatcctgccgggaaagtacaagggccaggatctcaacatcgtcagcgtgttcgaggccgtcggccagttcaccgcgggcaacatgagcgaggaagacttctgccagatcgagcgacgcgcgatcccgggcagtggctcctgcgggggcatgtacaccgccaacaccatgagttcggccttcgaggccctgggcatgagcctgccgttcgcctccacgatggccaatgtcgaggacccgatcgtcgcgcacaccaaggaagcggcgcgcgtgctggtcgaggcagtgaaggccgacctcaagccgcgtgacatcgtcacacgcaagagcatcgagaacgcggtcgcggtgatcatggccaccggcggctcgaccaatgcggtgctgcacttcctggccatcgcgcacgccgccggcgtcgagtggacgatcgacgacttcgagcgcgtgcgccgcaaggtgccggtgctgtgcgacctcaaacccagcggcaggtacctggcgatcgacctgcaccgcgccggcggcatcccgcaggtgatgaagacgctgctcgccgccgggctgatccacggcgactgcatcaccatcaccggaaggaccgtggccgagaacctggccgacatccccgatgcgccgcgcgccgaccaggacgtgatccgcccgatcacgaagccgatgtacgagcaaggccacctggccatcctgaagggcaacctgtcgcctgagggcgccgtggccaagatcaccggcctgaagaatcccagcatcactggcccggcgcgcgtgttcgacgacgagcagtcggcgctggccgccatcatggccaagcagatccaggccggcgacgtgatggtgctgcgctacctgggcccgatggggggcccgggcatgcccgagatgctggcgccgaccggtgcgctgatcggccaagggctgggcgaatcggtggggctcatcaccgacggccgcttctccggcggcacctggggcatggtggtcggccacgtggcacctgaggccgcggccggcggcacgatcgcgctggtgcaggaaggcgactcgatcaccatcgatgcgcacacgctggtgctcaacctcaacgtgagcgaggccgagatcgcaaagcgtcgcgccgcctggaaggcaccggcgccgcgctacacacgcggcgtgctggccaagttcgcgaagaacgcgtcaagcgccagcagcggcgcggtattggaccgcttcgagtag

SEQ ID NO: 372 - protein, 560 aa, Methylibium petroleiphilum
MSINRRSKNITEGVARAPNRSMYYAMGYQEADFKKPMIGVANGHSTITPCNSGLQKLADAAVEGIEAAGGNAQIFGTPTISDGMAMGTEGMKYSLVSREVIADCVETCVGGQWMDGVLVVGGCDKNMPGGMMGMLRANVPAIYVYGGTILPGKYKGQDLNIVSVFEAVGQFTAGNMSEEDFCQIERRAIPGSGSCGGMYTANTMSSAFEALGMSLPFASTMANVEDPIVAHTKEAARVLVEAVKADLKPRDIVTRKSIENAVAVIMATGGSTNAVLHFLAIAHAAGVEWTIDDFERVRRKVPVLCDLKPSGRYLAIDLHRAGGIPQVMKTLLAAGLIHGDCITITGRTVAENLADIPDAPRADQDVIRPITKPMYEQGHLAILKGNLSPEGAVAKITGLKNPSITGPARVFDDEQSALAAIMAKQIQAGDVMVLRYLGPMGGPGMPEMLAPTGALIGQGLGESVGLITDGRFSGGTWGMVVGHVAPEAAAGGTIALVQEGDSITIDAHTLVLNLNVSEAEIAKRRAAWKAPAPRYTRGVLAKFAKNASSASSGAVLDRFE

SEQ ID NO: 373 - DNA, 1683 bp, unknown
  gamma proteobacterium KT 71
atggcgctcaatcgtcgctccaaaaacatcaccgagggcgtccaacgtgcgcccaatcgctccatgtactacggcatgggctatgaggagggcgattttaggaagcccatggtgggcattgccaactctcactcgacgatcacgccctgtaatgcgggactccagcccctggctgatgccgctcaggaaggcctgaaagaagccggggccaatcctcaggtgtttggcacgccgaccatatccgacggcatgtccatgggtaccgagggcatgaagtactccctggtatcccgggaagttatcgctgactgcatcgaaacctgcgtgggcggtcagtggatggacggcgtgctggtgatcggtggctgtgacaaaaacatgcccggcggcatgatgggcatgctccgcgcaaacgtcccctcgatttttgtatacggcgggaccattcttcccgggcgtcacaatggtcaggatctgaacatcgtcagcgtgtttgaggcggtcggtgagcatgcggcggggcgtatcagggacgaggatttactggctatcgaacgcaatgcgattccgggaacgggctcctgcggcggtatgtataccgcaaacaccatgagctcggcctttgaggccctgggcatgagccttccttattcctcgaccatggcaaacgtcgagtccgaaatcaaagaatcagccaaggcgagcgcgctggctctggtggaggcgattcgcctggatcttaagcccagggatattgtgacccgcgagtccctggaaaatgccgttgcggtgattatggcgaccgggggatcgaccaatgcggtattacactttctggcgattgcccacgccgcggagattgactggagtatcgacgactttgagcgaatccgacaaaaagtaccggtgctctgcgatctcaagcccagcggggagtatctggccattgatctgcaccgtgctggcggcattccccaggtgatgaaaattctcttggacgggggcttgctccacggcgactgcatgaccgtaacgggcaagactattgcggaatccctggcggatgtgccttcgacgcccgtggaccccaaggtcattcgtcctctggataaccccatgtatgccaaggggcatctggcgattcttcgcggcaatctcgccgaagagggcgccgtagccaaaatcacgggtctgaaaaaccccgtgatcacgggacctgcgaaagtgtttgatgatgaacagtcggcccttgatgccattctcgcgggcaaggtcaaagccggtgacgtggtggtactgcggtatctagggccccagggcggaccgggtatgcccgagatgctggcacccaccagtgctctggtggggcagggtctcggggagtccgtaggcctgattaccgacggccgattttccgggggcacctgggggatggttgtggggcatgtggcacccgaagcctatgcgggtggtctcattgccctgatagaggagggggactccatcaccatcgatgcccataccctgagtctggaactcaatgtcgacgacaaagaaattgctcgccggcgcggcgcctgggtaaagcccgagccacgctacacccggggcgtcctcgccaagtttgcaaaaaatgcagccaccgcaagccgcggcgcggtgctggatctgtatgaggactaa

SEQ ID NO: 374 - protein, 560 aa, unknown
  gamma proteobacterium KT 71
MALNRRSKNITEGVQRAPNRSMYYGMGYEEGDFRKPMVGIANSHSTITPCNAGLQPLADAAQEGLKEAGANPQVFGTPTISDGMSMGTEGMKYSLVSREVIADCIETCVGGQWMDGVLVIGGCDKNMPGGMMGMLRANVPSIFVYGGTILPGRHNGQDLNIVSVFEAVGEHAAGRIRDEDLLAIERNAIPGTGSCGGMYTANTMSSAFEALGMSLPYSSTMANVESEIKESAKASALALVEAIRLDLKPRDIVTRESLENAVAVIMATGGSTNAVLHFLAIAHAAEIDWSIDDFERIRQKVPVLCDLKPSGEYLAIDLHRAGGIPQVMKILLDGGLLHGDCMTVTGKTIAESLADVPSTPVDPKVIRPLDNPMYAKGHLAILRGNLAEEGAVAKITGLKNPVITGPAKVFDDEQSALDAILAGKVKAGDVVVLRYLGPQGGPGMPEMLAPTSALVGQGLGESVGLITDGRFSGGTWGMVVGHVAPEAYAGGLIALIEEGDSITIDAHTLSLELNVDDKEIARRRGAWVKPEPRYTRGVLAKFAKNAATASRGAVLDLYED

SEQ ID NO: 375 - DNA, 1665 bp, Tremblaya princeps
atgaacacgaactcaagacgcataacgcatggattcaccaggtctccgaacagggccatgctctgtgccatggggtacgatggcgcagactttgccaagcccatcataggcgtaggaagcggttactccaccataacaccgtgcaatgctggcatacagcgcgtcgtcgatgcggcgaaagccatgctggcaaggcatggagccatgacgcaggttttcggcatccctaccatatccgacggcatatcaatgggcacgccgggcatgaggtactctctcgtgtctcgtgaggtgatcgctgattgtatagaggcatgtgcttgtgggcagagcatggacgggctgctagtcgtagggggctgcgataagaacctgcctggtggcatgatcgggctactacgagccaacatcccagggatttacctgtatggcggcacaatactgccagggtactggggcgccagggagctgactgtggtgagttcattcgaggcagttggcgccatgggtaggcagggcatgtctatagacgctatgcgtgaagtggagcgacacgcctgccccactacaggctcgtgcggcgggatgtacacagcaaacacaatgagcgcatcatttgaggcccttggcatgtccctgctctactcgtccactgctccgagcccaggcatcgagggtgagctatccatctcaacgtcggcacggtctctgatcaacgcagtgcgacggggcataaggccaagggacgtggtaactcacaggtccattcgcaatgccatggcggttgtaatggcagtcggcgggtctacaaacgccgtgctgcactacctggcgatagccgctgcagctcgttctgctctctcactgcacgacgttgagctaataaggaggagggtgcctgtaatatgtaacatgaagccctctggactgcatagcactgcagacctacattcagcaggcggcgttcctcgtgttatgcacgagcttgcgctcgctggtctcattgacgagtcgtgcctcacgataacgggcagaacgataggtgcagagctcctcgcggcgcaccgcaagcgccatggctctaccgttgtgctgcctactaacatggcgttataccgtacaggacgccttgttgtgctgagcggtaatatgtcaaggaacggcgcagttgccaagacttcaggccttagcatactattgcacagcggcactgccagagtgtttcgcagcgaggaggcctgtgttcaggctatactcaacggctgcgtgcgcattggcgacgtagttgtgctgatttacctaggcccaaagggagggcctggcatgcctgagatgctatccccaactgcagcgctagttggcatgggactaggccagtccgcttgcctcattacagatggtaggttctctggaggaacgtggggcctggtggtcgggcatgtatcacccgaggcagccgtgggtggctccatagcgcttgtccgtaacggcgacttcatcacagtagacctgcgcaacaactctcttcacctgcatatagacgcatggtcgcttgctgcacggcgtgcagcatggcggctaccttgcactttgtgtgtagagggactactgagaaagtaccacgatggagttggccagtctcacaatggcgccatcgctgcatag

SEQ ID NO: 376 - protein, 554 aa, Tremblaya princeps
MNTNSRRITHGFTRSPNRAMLCAMGYDGADFAKPIIGVGSGYSTITPCNAGIQRVVDAAKAMLARHGAMTQVFGIPTISDGISMGTPGMRYSLVSREVIADCIEACACGQSMDGLLVVGGCDKNLPGGMIGLLRANIPGIYLYGGTILPGYWGARELTVVSSFEAVGAMGRQGMSIDAMREVERHACPTTGSCGGMYTANTMSASFEALGMSLLYSSTAPSPGIEGELSISTSARSLINAVRRGIRPRDVVTHRSIRNAMAVVMAVGGSTNAVLHYLAIAAAARSALSLHDVELIRRRVPVICNMKPSGLHSTADLHSAGGVPRVMHELALAGLIDESCLTITGRTIGAELLAAHRKRHGSTVVLPTNMALYRTGRLVVLSGNMSRNGAVAKTSGLSILLHSGTARVFRSEEACVQAILNGCVRIGDVVVLIYLGPKGGPGMPEMLSPTAALVGMGLGQSACLITDGRFSGGTWGLVVGHVSPEAAVGGSIALVRNGDFITVDLRNNSLHLHIDAWSLAARRAAWRLPCTLCVEGLLRKYHDGVGQSHNGAIAA

SEQ ID NO: 377 - DNA, 1689 bp, Blastopirellula marina
atgtctcagcccctcaattggaatagtcgccgtttaacgcgtggatggcaaaaagggatcaccgctttttattacggcttgggactgaccgacgccgattttgacaaaccgcagatcgggatcggcgtgccgctgctggacggcaatctttgcaacgtccacgcctatcaactgggccaagagctgaaagcaggctgcgagcaagcgggactgatcgggtttccgtttggcacgccggccgttagcgataacatcacgcaaggacatgaagggggcaacgccagccttccctcgcgtaatatgatcgccaatgcggctgaatgcgtcgtcagcgcccatggctacgactttttgatcggactgcacaattgcgacaaaaacgggcccggcttcgccatggcgttggctcggctcaactatcccgggctgatcgtcaacggcggcagtattaaacctggttgccatctgggccgcgacacgtcgatcttggatgtctacgacgcccaagcggcggcttccgtgggcgcaatgacggcggacgaagcggatcagatcttgcgaaccgcttgtcccggacccggcgggtgcggcatcgccgcttcttttaatacttggggaatcgcgatcgaagcgatcgggctagggcttccctactccagttcgatcccggctgaagatccggccaaacgcgaagaatgccgcagcatcggccaagcagtcaagcatctgctgaccgagaacattcgcccccgcgatattttgaccaaaaaggcgtttgaaaacgcagccgcggtgatcgccgccgtgggcggctcgaccaacggcgtgctgcacctgatcgcgctggccaaagaagccgaagttgatttcacattgcgtgacgtgcagcggattgtccgcaacacgccggtcctgtgcagcttcgctccgcgcggcaaacgcacgatgtacgacctgcacaagctggggggtacgccgatgctgctgaagtacttgatctcggtcggcattgtcgatggttcgtgcctgaccgtctcgggcaagtcattggccgaaaacgtcaacggcgcggccgatgttcccgcggatcaagacttgatcgcgacgatcgaaaagccgttcaaagaatatgccgacatgcagatctgctttggcaacctggcgcccggcggcgtggtcttcaaagtatcgagcatgcgtgacccaaaattcagcggcaaagcgatctgcttttcggaagccaaggatatcgtcaacgcggtcgaagcgaataagatcacgccgggaaccgtgatcgtgcttcgttatctggggccggtcgcttcggggatgccggaagtgttggtcgcgaccgcggctttggccgtaccgcatctggacggcaaagtagcgtttctgtcagacacgcgcgtctctggcgtatcgcacggagcgatcggcgttcactgtgctccggaagcggcagtcggcgggccgatcgcgttggtggaagacggggatgaaatctcgtttgatctgctcggcggcgagatcacgctgcacgtcggagcagacgtgttggcgactcgcgccgccaactggaagacgcctgacctgcggcacaaacatgcctatctggccgacttcgccgcaaccgtctcgcaagccgatagcggttgcgtcagcaaagcgtttcacgacgtctcgtaa

SEQ ID NO: 378 - protein, 562 aa, Blastopirellula marina
MSQPLNWNSRRLTRGWQKGITAFYYGLGLTDADFDKPQIGIGVPLLDGNLCNVHAYQLGQELKAGCEQAGLIGFPFGTPAVSDNITQGHEGGNASLPSRNMIANAAECVVSAHGYDFLIGLHNCDKNGPGFAMALARLNYPGLIVNGGSIKPGCHLGRDTSILDVYDAQAAASVGAMTADEADQILRTACPGPGGCGIAASFNTWGIAIEAIGLGLPYSSSIPAEDPAKREECRSIGQAVKHLLTENIRPRDILTKKAFENAAAVIAAVGGSTNGVLHLIALAKEAEVDFTLRDVQRIVRNTPVLCSFAPRGKRTMYDLHKLGGTPMLLKYLISVGIVDGSCLTVSGKSLAENVNGAADVPADQDLIATIEKPFKEYADMQICFGNLAPGGVVFKVSSMRDPKFSGKAICFSEAKDIVNAVEANKITPGTVIVLRYLGPVASGMPEVLVATAALAVPHLDGKVAFLSDTRVSGVSHGAIGVHCAPEAAVGGPIALVEDGDEISFDLLGGEITLHVGADVLATRAANWKTPDLRHKHAYLADFAATVSQADSGCVSKAFHDVS

SEQ ID NO: 379 - DNA, 1692 bp, Planctomyces maris
atggatcatcctttaaactggaatagtcaaaacctgacacatggctggcaacggggagtcaccgctttttattacgggttaggcttttcggatcaggatttcgacaaggcccagatcgggattggcgtgccactcttggatggcaacctctgtaatgtgcatgcttacgatcttgcgaaagtaattgcacagggatgtcaatccgctgacatgatcggtcttccttttggagttcccgccgtcagtgacaacatcacccagggacaggaaggaggcaacgccagtctcccctctcggaatatgatcgccaacgcggccgaatgcgtcgtgagtgctcattcgtatgatgccctgattggcctgcataattgcgataaaaacggaccgggcttcgccatggcattggcacgactcaactatccgggactggtcgtcagtggtggcagtatcatgcccggctgccacaaaggacaggacatttcgatcctcgacgtctacgattcccaggcagctgcagcagtcggcgcgatggaagaagaagaagcggaccagattctgaaaaccgcctgcccgggcccggggggatgtggtatcgccgcttctttcaatacctggggcatcgcgctcgaagccatcggccttatgctcccgttcagcagttccacgccggccattgataatgcaaaaaaaacagaatgcctcaatgtcgcctctgccgtgcgaaatctcctgcagaaaaatatccggccgcgcgacatcctgacccgcaaagcatttgaaaatgcagccgccaccatcgcggccgtcggcggctccacgaatggaatcctgcatctgctcgcgctggcacgagaagcggaagtcgaattttacctgcaggacattcaggaaattcttcgaaaaacgcccgtgtattgcagttttgcaccacgcggcaaaaaaaccatggtcgacctgcatcacctgggtggcacaccggtcctcatgaaacacctgctcaaagcaggcatcatcgatggcagttgcctgactgtaaccggcagaaccctggcggaaaacctggcagaaatcggcgatgtccccacgaaccaggaactgatcgcttcgctcgatcaaccgtataaaacttacgccgacatgcagatctgctttggcaatctggcaccgggaggcattgtctttaaagtttccagcatgcaggaatcacatttcacgggaaccgcctgctgcttcgatgaagcgaaaggcgtagtcgatgccgtcgaagcaggtaagatcaaacccggcagtgtcatcgtactacgaaacctgggtccggtcgcatcaggcatgcctgaagtacttgtcgcgactgccgctctgacggtaccggaactggatggcaaagtggcattcatttcggacacacgtgtctccggtgtttcacacggtgccatcggcgtgcattgttctcccgaagcggcagtcggaggtccgattggtctgattcaggatggtgaccagatctcgttcgatctgcttaaaggagaaatcagcgttgatgtctccgaccaggaatttcagcaacgccgagtgaaaaaaccacttcaacccgtcagacattcccgcggctatctggctgatttttcagccaccacctcacaggcacatcatggctgtgtgagtaaagccctgctgccggactgcgaataa

SEQ ID NO: 380 - protein, 563 aa, Planctomyces maris
MDHPLNWNSQNLTHGWQRGVTAFYYGLGFSDQDFDKAQIGIGVPLLDGNLCNVHAYDLAKVIAQGCQSADMIGLPFGVPAVSDNITQGQEGGNASLPSRNMIANAAECVVSAHSYDALIGLHNCDKNGPGFAMALARLNYPGLVVSGGSIMPGCHKGQDISILDVYDSQAAAAVGAMEEEEADQILKTACPGPGGCGIAASFNTWGIALEAIGLMLPFSSSTPAIDNAKKTECLNVASAVRNLLQKNIRPRDILTRKAFENAAATIAAVGGSTNGILHLLALAREAEVEFYLQDIQEILRKTPVYCSFAPRGKKTMVDLHHLGGTPVLMKHLLKAGIIDGSCLTVTGRTLAENLAEIGDVPTNQELIASLDQPYKTYADMQICFGNLAPGGIVFKVSSMQESHFTGTACCFDEAKGVVDAVEAGKIKPGSVIVLRNLGPVASGMPEVLVATAALTVPELDGKVAFISDTRVSGVSHGAIGVHCSPEAAVGGPIGLIQDGDQISFDLLKGEISVDVSDQEFQQRRVKKPLQPVRHSRGYLADFSATTSQAHHGCVSKALLPDCE

SEQ ID NO: 381 - DNA, 1839 bp, Salinibacter ruber
gtgaggctgccgtctttcacgcttcacgtttcacgcatcacgaaaacagcaccttctttcccttccacttttcccttttgcccaatgcccccctcctccgccaacggccactcctccaaaatccagagccaagacgtcaccgagggccttgaccaggcgccggcccgcgcgatgtttcgggcgatgggctacgacgacgccgacctcgaccagcccctcatcggcatcgccaacccggcggcggacgtgacgccctgcaatgtgcacctcgacggccttgccgacgccgcacgcgaaggcgtcactgaggccggcgggacgcccatcgagtttggcaccatcacggttagcgacgggatctcgatgggcacggagggcatgaaggggtccctcatctcccgcgaggtgatcgccgactcggtggaactggtggcctttgccgagcggctcgacgggctcgtcatcatgggcggctgcgacaaaaacatgccgggcatgatgatggcggcgatccgggccgacctcccgagcgtcttcctctacggcgggtccatcatgccgggccaccaccgggggcaggagatcacgatccagaacgtgttcgaggcgtgcggggcggtcgccaccggccagatgagcgaagaggagctcgacgagatggagcgccacgcctgtcccggcgccggcgcctgcggcggcatgttcaccgctaacacaatggcgtccatcagcgaggcgatcggctttgcgccgctggggagcgcgagccccccggcggtgacagaagaacgagaggtggtggcccgcgcggccgggcggcggaccgtcgaggcgatcgaggaacggcggcggccctccgacttcctcagcaagaagtcgttcgagaacgccattgccctccaggtggccgtgggcggctccacgaacggcgtactccacctgctcgcgatggcggcggaggcgggcatcgacctctcgattgaggcgttcgacgcaatcagccggcggacgcccaagatcggcgacttccagcccggcggctcccgcgtgatgaacgacctgcacgaggtcggcggcgtgccggtggtgctgaaggcgcttctcgatgcgggcctgctgcacggcgacgcccagaccgtgacgggggagcccctcgccgaggccctcgaccgcgtcgacccgcccgccatcgcggacctcgacgtggactacctctacacggtggacgaaccgaagaatgaggagggcgccatccgcatcctcaccggcaacctcgcccccgacggcgctgtgctcaaagttacagccgctgatgccccccgctttgagggcacggcccgcgtcttcgagagcgaggaggacgcaatggactacgtgcaggccggccagctcgactcgggcgacgtcattatcattcggaatctcgggcccaagggcgcccccggcatgcccgaaatgcttggcgtgaccgccgcccgggacggacaggggcacgccgacgacgtggccctcatcaccgacgggcgcttctccggggccacccgcggcctctccatcggccacgtcgcccccgaggccgcggccggcgggcccatcgccgccatccaggacggagacccgatcatcatcgacgtggcggagcgtcacctggcggtcgacctgtccgacgccgagctggagcgccgactcgacgaccggtcgcccccggagccccagtacacgaccggcgttctcgccaagtacgccgccctcttcggctccgccgcggagggggcagtgacgagtgtcttttcggatcttcgcgagtcgacatccccctccacggcttcaaatgaatga

SEQ ID NO: 382 - protein, 612 aa, Salinibacter ruber
MRLPSFTLHVSRITKTAPSFPSTFPFCPMPPSSANGHSSKIQSQDVTEGLDQAPARAMFRAMGYDDADLDQPLIGIANPAADVTPCNVHLDGLADAAREGVTEAGGTPIEFGTITVSDGISMGTEGMKGSLISREVIADSVELVAFAERLDGLVIMGGCDKNMPGMMMAAIRADLPSVFLYGGSIMPGHHRGQEITIQNVFEACGAVATGQMSEEELDEMERHACPGAGACGGMFTANTMASISEAIGFAPLGSASPPAVTEEREVVARAAGRRTVEAIEERRRPSDFLSKKSFENAIALQVAVGGSTNGVLHLLAMAAEAGIDLSIEAFDAISRRTPKIGDFQPGGSRVMNDLHEVGGVPVVLKALLDAGLLHGDAQTVTGEPLAEALDRVDPPAIADLDVDYLYTVDEPKNEEGAIRILTGNLAPDGAVLKVTAADAPRFEGTARVFESEEDAMDYVQAGQLDSGDVIIIRNLGPKGAPGMPEMLGVTAARDGQGHADDVALITDGRFSGATRGLSIGHVAPEAAAGGPIAAIQDGDPIIIDVAERHLAVDLSDAELERRLDDRSPPEPQYTTGVLAKYAALFGSAAEGAVTSVFSDLRESTSPSTASNE

SEQ ID NO: 383 - DNA, 1686 bp, Microcystis aeruginosa
atggcagataactacagaagtcgcattgttacccaaggtacccaacgcagtcctaatcgggccatgttaagagcggtaggttttggggatgaggactttagcaaaccaatcatcggcattgctaacggatttagcaccattaccccctgtaacatgggaattaatgatttagcaatgcgtgccgaagcagccaccagattagcggggggaatgccgcaacttttcgggactatcaccattagtgacgggatttccatgggaacagaaggaatgaaatattctctcgtttctagggaagtaatcgccgattccattgaaaccgtctgtaatggtcaaagtctcgatggagtcctcgctatcgggggttgtgacaaaaatatgccgggagcaatgattgccatggcccggatgaatattcccgctattttcgtctatggtggcacaattaaaccgggacgctacaaagattgcgatttaaccgtggtcagttcctttgaagccgtgggacagtacagcgccggtaaaatcagcgaagaagacctcatcgggattgaacgcaacgcttgccccggtgctggttcctgtggtggaatgtttactgctaataccatgtcttccatttttgaagccatggggatgagtttaccctattcctcaaccatggccgccgaagatgaggaaaaagccgatagtaccgaagaatcggccaaggttttagtcgaggcggttagaaaacagattctacctagccaaattttgacccgtaaagcctttgaaaacgccatttcggtaattatggcggtgggaggttccactaacgctgtcctgcaccttttagccatttcccgcaccatcggggtagaattatcgatcgatgattttgaaaccatccgccagcgtgtaccagttatctgcgatcttaaaccctccgggcgttacgttaccgtagatctgcataaagccggcggtattccccaagtgatgaaaattctcctggttaatggtttactacacggggatgctctcaccattagcggtcagactatcgccgagattttagccgatattcccgaccaaccgccctcaggccaagatgttatccgtccttttagcaatcctgtctataaagagggtcatttagccattttaaaaggaaatctggccacggaggggtctgtggccaaaatcagcggcgtgaaaactccggtcatcactgggcccgcgcgggtgtttgagtcggaagaaacctgtttagaggcaattttagccggaaaaattcaagccggggatgtggtggttgtccgttacgagggaccagtaggcggaccgggtatgcgggaaatgttagcccccacttcggcaattatcggcgctggtttaggggattccgtgggattaattaccgatggtcgtttttccgggggaacctatggcatggtagttggtcacgtcgctccagaagcggcggtgggtggtacaattgccctagtagaggaaggggatcaaatcactattgatgctcgtcaacgtctcttgagtttaaatgtatcggaggaagaattaacccgtcgtcgtcaccattggcaaccgcgtcccccacgctataaaacgggaattctcggcaaattcgccaagttagtctcctctagcagtctcggcgctttaacggatttgaatctgttctaa

SEQ ID NO: 384 - protein, 561 aa, Microcystis aeruginosa
MADNYRSRIVTQGTQRSPNRAMLRAVGFGDEDFSKPIIGIANGFSTITPCNMGINDLAMRAEAATRLAGGMPQLFGTITISDGISMGTEGMKYSLVSREVIADSIETVCNGQSLDGVLAIGGCDKNMPGAMIAMARMNIPAIFVYGGTIKPGRYKDCDLTVVSSFEAVGQYSAGKISEEDLIGIERNACPGAGSCGGMFTANTMSSIFEAMGMSLPYSSTMAAEDEEKADSTEESAKVLVEAVRKQILPSQILTRKAFENAISVIMAVGGSTNAVLHLLAISRTIGVELSIDDFETIRQRVPVICDLKPSGRYVTVDLHKAGGIPQVMKILLVNGLLHGDALTISGQTIAEILADIPDQPPSGQDVIRPFSNPVYKEGHLAILKGNLATEGSVAKISGVKTPVITGPARVFESEETCLEAILAGKIQAGDVVVVRYEGPVGGPGMREMLAPTSAIIGAGLGDSVGLITDGRFSGGTYGMVVGHVAPEAAVGGTIALVEEGDQITIDARQRLLSLNVSEEELTRRRHHWQPRPPRYKTGILGKFAKLVSSSSLGALTDLNLF

SEQ ID NO: 385 - DNA, 1731 bp, Methylobacterium chloromethanicum
atggacgcgcgtcagaccgacaagtcgaagctgccgagccggcacgtgacggaggggcccgagcgggcgccccaccgctcgtacctctacgccatgggcctgacgaccgagcagatccaccagccgctggtcggcgtcgcctcgtgctggaacgaggccgcgccctgcaacatctcgctgatgcgccaggcccaggccgtgaagaagggcgttgccgccgccaagggcaccccgcgcgagttctgcaccatcaccgtcaccgacggcatcgccatgggccatggcggcatgcgtgcctcgctgccgtcgcgcgaggtcatcgccgattcggtcgagctgacgatccgcggccattcctacgacgccctcgtggggctggccggctgcgacaagtccctgcccggcatgatgatggccatggtgcgcctcaacgtgccgtcaatcttcatctatggcggctcgatcctgccgggctcgttccggggccggccggtcacggtgcaggatctgttcgaggcggtcggcaaggtcgccgtcggtgacatgagcctcgacgacctcgacgagctggagcgggtcgcctgcccctcggccggcgcctgcggcgcgcagttcaccgccaacaccatggccaccgtctccgaggcgatcggcctcgcgctgccctactcggccggcgcgcctgccccttatgagatccgcgaccaattctgcgccgccgccggcgagaaggtgatggagctgatcgccaagaacatccgcccgcgcgacatcgtcacccgcaaggccctggagaacgccgctgcgacggtcgcggcctcgggcggttcgaccaacgcggccctgcacctgccggcgatcgcgcatgaatgcggcatcgagttcaccctgttcgacgtcgccgagatcttccgcaagaccccctacatcgccgacctgaagcccggtgggcgctacgtggccaaggacatgttcgaggtcggcggcatcccgctgctgatgaagacgctgctcgaccacggctacctgcacggcgactgcctcaccgtcaccggccgcaccatcgcggagaacctcgccaaggtcgcctggaacccggatcaggacgtcgtgcgcccggccgataagcccatcaccgtcaccggcggcgtggtgggccttcgcggcaatctcgcccccgagggcgcgatcgtgaaggtcgccggcatgccgcccgaggcccaggtcttcaccggcccggcccgcgtcttcgacggcgaggaagcctgtttcgaggcggtgcagaaccgcacctacaagcccggcgacgttctggtcatccgttacgagggcccgaagggaggccccggcatgcgcgagatgctctcgaccaccgccgccctctacggccagggcatgggcgacaaggtggccctcatcaccgacgggcgcttttccggcgcgacccgcggcttctgcgtcggccatgtcggccccgaggctgccatcggcgggccgatcggcctgctgcgcgacggcgacatcatcaccctcgacgcgatcaagggcacgctcgacgtggcgctctccgacgaggaactggcccagcgtcgcagcgaatgggcgccgcggggcaatgccgcgacctccggctacctctggaaatatgcgcagtccgtcggacctgcggtgaacggggccgtgacgcatccgggcggcgcgggggagacgaacgtctatgccgacatctag

SEQ ID NO: 386 - protein, 576 aa, Methylobacterium chloromethanicum
MDARQTDKSKLPSRHVTEGPERAPHRSYLYAMGLTTEQIHQPLVGVASCWNEAAPCNISLMRQAQAVKKGVAAAKGTPREFCTITVTDGIAMGHGGMRASLPSREVIADSVELTIRGHSYDALVGLAGCDKSLPGMMMAMVRLNVPSIFIYGGSILPGSFRGRPVTVQDLFEAVGKVAVGDMSLDDLDELERVACPSAGACGAQFTANTMATVSEAIGLALPYSAGAPAPYEIRDQFCAAAGEKVMELIAKNIRPRDIVTRKALENAAATVAASGGSTNAALHLPAIAHECGIEFTLFDVAEIFRKTPYIADLKPGGRYVAKDMFEVGGIPLLMKTLLDHGYLHGDCLTVTGRTIAENLAKVAWNPDQDVVRPADKPITVTGGVVGLRGNLAPEGAIVKVAGMPPEAQVFTGPARVFDGEEACFEAVQNRTYKPGDVLVIRYEGPKGGPGMREMLSTTAALYGQGMGDKVALITDGRFSGATRGFCVGHVGPEAAIGGPIGLLRDGDIITLDAIKGTLDVALSDEELAQRRSEWAPRGNAATSGYLWKYAQSVGPAVNGAVTHPGGAGETNVYADI

SEQ ID NO: 387 - DNA, 1797 bp, Schizosaccharomyces pombe
atgatgttctgcaagcttctccgttgtcaaaacggtattgctagcaaaagagctgcattaagcctaaaaggctttaaaacctcttcgatcaatttagtcgagaagaaattgaacaagtatagtgaaacaatcactggtccgaagtctcagggtgcttcccaagctatgttatatgctactggacttaatgaggaggacatgaaaaaaccccaagtcggcattgctagttgttggtatgaaggaaatccttgcaatatgcatttacttgatctcggtcgacgagtgaaagaaggtgtcaaaaaggctggattgaccggattccagtttaatactattggtgttagtgatggtatttctatgggtactactggtatgcgttatagtttgcaatctcgtgagattattgcagactccattgagaccgtcatgcaaggtcaatggtatgatgccaacgtctctattcctggctgtgacaaaaacatgcctggttgtttaatcgctatgggaagattcaaccgccctagtattatggtttacggcggtagtattcgtgctggtcactctccttgtcagaacaatgcacccatcgatattgtttctgcttttcaatcctatggtgaatttatcacaggaaaaattgatgagccaacccgtcatgacattattcgtcatgcatgtcctggaggtggtgcttgtggtggtatgtatactgcaaatacaatggctagctgtgccgaagctatgggtatgacattacccggttcttcttcttaccttgctggctcacctgagaagtttgcagaatgcgaagctgcaggtagtgctataaagcgacttttggttgacgacattaaacctcgcgacatcatgacacgttctgcttttgaaaatgctatggtcttgacgatgactcttggtggctctaccaactctgttcttcatttgatcgcaattgctaagtctgttggtatcactttaactttggatgatttccaagccgtcagtaaccgtacaccgtttattgccgatatgaagcctagcgggaagtacgttatggaagatttgttcgctatcggaggtattccttcagtacttaaatatctccatgctgaaggtctcatcgatggttctaatattaccgttactggtaaaactctcgctgagaacctacgaggattcaaggaccttgccgaaggtcaaaagatcattagacctttgagcaaccccatcaagaccgagggtcatttacgtgtcctccgtggttctttagcccctgaaggttctgtcgcaaagattactggcaaagagggcttgaacttcaccggcaaagctcgtgtttttgatgccgaaaacgattttattgctgccttagagcgtggtgagttcaagaagggcgagaagactgtcgtcattattcgttttgagggaccaaaaggtggacctggtatgccggaaatgttaaagccttcaagtgctattatgggagctggtcttggaaaggatgttgcacttttgactgacggtcgtttcagtggtggctctcacggatttttgattggacacgttgatcccgaagcacaagttggaggccctattgctcttgttcaggacggcgatgtcattgaaatcaatgctgtaaagaacactttagatttgatggttgatgagaaggagatggcgagacgccgcagtgtttggaaggcacctcctttgaagtaccaacaaggaacccttttaaaatatgctcgcaacgttagcactgcctccaagggtgctgttacagattccttagagtaa

SEQ ID NO: 388 - protein, 598 aa, Schizosaccharomyces pombe
MMFCKLLRCQNGIASKRAALSLKGFKTSSINLVEKKLNKYSETITGPKSQGASQAMLYATGLNEEDMKKPQVGIASCWYEGNPCNMHLLDLGRRVKEGVKKAGLTGFQFNTIGVSDGISMGTTGMRYSLQSREIIADSIETVMQGQWYDANVSIPGCDKNMPGCLIAMGRFNRPSIMVYGGSIRAGHSPCQNNAPIDIVSAFQSYGEFITGKIDEPTRHDIIRHACPGGGACGGMYTANTMASCAEAMGMTLPGSSSYLAGSPEKFAECEAAGSAIKRLLVDDIKPRDIMTRSAFENAMVLTMTLGGSTNSVLHLIAIAKSVGITLTLDDFQAVSNRTPFIADMKPSGKYVMEDLFAIGGIPSVLKYLHAEGLIDGSNITVTGKTLAENLRGFKDLAEGQKIIRPLSNPIKTEGHLRVLRGSLAPEGSVAKITGKEGLNFTGKARVFDAENDFIAALERGEFKKGEKTVVIIRFEGPKGGPGMPEMLKPSSAIMGAGLGKDVALLTDGRFSGGSHGFLIGHVDPEAQVGGPIALVQDGDVIEINAVKNTLDLMVDEKEMARRRSVWKAPPLKYQQGTLLKYARNVSTASKGAVTDSLE

SEQ ID NO: 389 - DNA, 1758 bp, Saccharomyces cerevisiae
atgggcttgttaacgaaagttgctacatctagacaattctctacaacgagatgcgttgcaaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttga

SEQ ID NO: 390 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 391 - DNA, 1752 bp, Kluyveromyces lactis
atgttttcacagtctgctgtaagaaggttttcaaccactagaaatgtgggcaagaagttgaacaagtactcgcatatcatcaccgaaccaaaggaccagggtgcatcgcaagcgatgctttatgccacggggtttaaggaagacgatttcggcaaggctcaagttggtgttggttcatgttggtggtctggtaatccatgtaatatgcatttgatggatttcaacaacagaatcaccgaatccgttaacaaggctgggttgaaaggtatgcaattcaataccattggtgtttctgatggtatttccatgggtaccaagggtatgagatattctttgcaatctagagaagttattgctgattcgttcgaaaccattatgatggctcaacattacgatgccaatatcgccattccatcttgtgataaaaacatgcctggtgttttgatggctatgggtagacataacagaccttccattatggtttatggtggtaccattttgccaggttctccaacttgtggttctgctaagattccaaagaagattgacgttgtttctgcgttccagtcctatggtcaatacttatccaaggaatttactgaaactgaaagacaagatgttgtgcaacatgcttgtccaggtccaggttcttgtggtggtatgtacactgctaacaccatggcctctgtggccgaagtcttgggtatgactttgccaaactcttcctctttcccagcagtttcaaaggaaaaattgaacgaatgtgacactatcggtgaagctatcaagaagactatggaactaggaattactcctcgtgacgttatgaccaaagaagctttcgaaaacgctatgacatatgtcattgctaccggtggttccactaacgctgttcttcatatggttgctgtcgctcactctgccggtgtcaagattactccagatgatttccaaagaattagtgacaagactccattgttgggtgatttcaaaccttctggtaaatatgtgatggcagatttgattaccgtcggtggtacccaagctgttatcaaatacttgtacgaagaaggcttcctacatggtaacactattaccatctccggtgacactttagcagaaagagcagctaaggctgtatctttgaaggatggtcaagacatcattcgtcctctaactaacccaattaagacaagtggtcatttacaaattctatacggaagtttggccccaggtgggtcagtcggaaaaattactggtaaagaaggtacttacttcaagggtaaggctagagtattcaacgacgaaccaggctttatttctgctttagaaaacggtgaaatcaagaagggtgaaaaaaccgttgtcattatcagatacgaagggccaagaggtggtccaggtatgcctgaaatgttaaagccatcttctgcattgatgggttacggtctaggtaaggatgttgctctattgactgacggtagattctccggtggttctcacggtttcttgatcggtcacatcgtcccagaagctgccgaaggtggtcctatcggtttggttcgtgacggtgacgaaattatcattgatgctgataacaacaagattgacttgttagttccagaagaagaaatcgctgaacgtagaagtacatggactgctccacctccacgttatactagaggatgtttatccaagtacgcaaaattggtttcaaatgcttcccatggttgcgtgactgatttgaactaa

SEQ ID NO: 392 - protein, 583 aa, Kluyveromyces lactis
MFSQSAVRRFSTTRNVGKKLNKYSHIITEPKDQGASQAMLYATGFKEDDFGKAQVGVGSCWWSGNPCNMHLMDFNNRITESVNKAGLKGMQFNTIGVSDGISMGTKGMRYSLQSREVIADSFETIMMAQHYDANIAIPSCDKNMPGVLMAMGRHNRPSIMVYGGTILPGSPTCGSAKIPKKIDVVSAFQSYGQYLSKEFTETERQDVVQHACPGPGSCGGMYTANTMASVAEVLGMTLPNSSSFPAVSKEKLNECDTIGEAIKKTMELGITPRDVMTKEAFENAMTYVIATGGSTNAVLHMVAVAHSAGVKITPDDFQRISDKTPLLGDFKPSGKYVMADLITVGGTQAVIKYLYEEGFLHGNTITISGDTLAERAAKAVSLKDGQDIIRPLTNPIKTSGHLQILYGSLAPGGSVGKITGKEGTYFKGKARVFNDEPGFISALENGEIKKGEKTVVIIRYEGPRGGPGMPEMLKPSSALMGYGLGKDVALLTDGRFSGGSHGFLIGHIVPEAAEGGPIGLVRDGDEIIIDADNNKIDLLVPEEEIAERRSTWTAPPPRYTRGCLSKYAKLVSNASHGCVTDLN

SEQ ID NO: 393 - DNA, 1770 bp, Candida albicans
atgagttttgtcaaatcttgcagagggtgtcttaggacatttgctacatccacaatcaagcatgagaaaaagttaaacaagtactcgtctattgtcacaggcgacccatctcagggtgcttcccaagcaatgctttatgccactggtttcagtgatgaagatttcgatcgtgcacaaatcggtgtcggttctgtttggtggtcaggtaacccatgtaacatgcacttgatggagttgaacaacaggtgttccgaatcagtcaacaaggccggcttaaaagccatgcaattcaactccattggtgtgtcggacggtatcaccaacggaactgaaggtatgaagtactctttacagctgagagaaattatcgccgactcctttgaaaccatgaccatggcccaactatatgacggtaacattgccattccttcatgtgataaaaatatgcccggggtattgatggctatgggaagacacaacagacctgccattatggtctatggtggtactatcttgcctggatctccaacttgcggaacccaaaaccctgctgtagccgacaaaatcgatatcattagtgctttccaatcctacggacaatacttgtcaaaacaaatcaacaacgaagaaagaatagatattgtcaaacatgcctgtccagggcccggtgcatgtggtggtatgtacactgccaacactatggcctctgcctctgaagtcttggggttgaccttaccattttcgtcctcgtccccggcagtctccaaagaaaaagccgaagagtgtgccaacgtcgggttcgccttaaagaatttgttagagttggacttgaaaccaagagatattgtcaccaaaaaatcatttgaaaacgctattgcttatatcattgccactggtggttctactaatgccgttttacatcttattgccattgcctcttcatttgacattactattactgttgacgatttccaaagaatctccgacaacactcccttgttggccgatttcaaaccatcgggtaaatacgttatggccgacttgcaaaatgtcggcggtacacctgctgttatgaaatacttgatcaaagaaggcattatcgacggtacccaattgagtgtcaccggtaaaaccatcaacgaaaacttggctaaacttgctgatttgcctgagggccaagacattgttagaccagtatcaaacccattgaagccaagtggccacttacaaatcttgaaaggtactttggctccagggtctgctgtcgctaaaatcaccggtaaagaaggtacttatttcaaaggtaaagctagagtattcaacgacgaaggtgcatttattgttgccttggaaaatggcgagatcaaaaaaggcgaaaaaacagtttgtgtgatcagatacgaaggtccaaaaggtggtccaggtatgccagaaatgttgaaaccttcgtctgcattaatgggttacgggttaggtaaagacgttgctttgttgactgatggtagattttcgggtggttcccacgggttccttattggccacattgttcctgaagccgctgaaggtggtccaattgctttggttgaagatggcgatattattgtcatcgacgcagacaataacaaaatcgatttgttggttgagccagacgtcttgaccgaaagaagaaaacactggacgcctccagaaccaagatacaaaagaggtactttggccaaatacgccaagttggtcagcgatgcatctaagggatgtgttacagatttataa

SEQ ID NO: 394 - protein, 589 aa, Candida albicans
MSFVKSCRGCLRTFATSTIKHEKKLNKYSSIVTGDPSQGASQAMLYATGFSDEDFDRAQIGVGSVWWSGNPCNMHLMELNNRCSESVNKAGLKAMQFNSIGVSDGITNGTEGMKYSLQSREIIADSFETMTMAQLYDGNIAIPSCDKNMPGVLMAMGRHNRPAIMVYGGTILPGSPTCGTQNPAVADKIDIISAFQSYGQYLSKQINNEERIDIVKHACPGPGACGGMYTANTMASASEVLGLTLPFSSSSPAVSKEKAEECANVGFALKNLLELDLKPRDIVTKKSFENAIAYIIATGGSTNAVLHLIAIASSFDITITVDDFQRISDNTPLLADFKPSGKYVMADLQNVGGTPAVMKYLIKEGIIDGTQLSVTGKTINENLAKLADLPEGQDIVRPVSNPLKPSGHLQILKGTLAPGSAVAKITGKEGTYFKGKARVFNDEGAFIVALENGEIKKGEKTVCVIRYEGPKGGPGMPEMLKPSSALMGYGLGKDVALLTDGRFSGGSHGFLIGHIVPEAAEGGPIALVEDGDIIVIDADNNKIDLLVEPDVLTERRKHWTPPEPRYKRGTLAKYAKLVSDASKGCVTDL

SEQ ID NO: 395 - DNA, 1815 bp, Pichia stipitis
atgagttttttatttaaggctgctgccgcacgccgtgttgcctccaagtcgcctgctgctgtggccagatcgttttctgtctctgctactcaatgtgaaaagaaattgaacaagtactcttcgattgtcactggtgatccctcccagggtgcttcgcaagccatgctctatgccacaggtttcgacgatgccgacttcaacagagcccagatcggtgtgggctcagtttggtggtcaggtaatccttgcaacatgcacttgatggagttgaacaacaagtgtactgaatcagtcaacagagctggtttgaagggaatgcaattcaactcgattggtatttccgatgggatcactaacggaactgaaggaatgagatactctcttcaatctcgtgaaattattgctgactcgttcgaatccatgatgcttggtcaattgtacgatggtaacattgccattccatcctgtgacaagaatatgcctggtgtcttgattgctatggccagacacaacagaccttctattatggtctatggtggtacaatcttgccaggtcaaactacttgcggaaccaacaacccagctatcgccgacaaaattgatatcatctcagctttccagtcgtatggacagtacttgaccaagtccatcactaacgaagaaagaaaggatatcgttagacacgcctgtcctggtcctggtgcctgtggtggtatgtatactgctaacaccatggcatctgcagctgaatgtcttggtatgtctttgccctattcatcttcggctccagccgtctcaaaggaaaaggatgctgagtgtgccaacatcggtcaagccatcaagcacttgttggagatcgacttgaagccccgtgatattttgactaagaaatctttcgaaaacgctatcgcttatatcattgctactggtggatctacgaatgctgtattgcacttaattgccattgcttcctcagctgatattgatcttaccgtagatgatttccagagaatctccgactccactccgttgttggcagacttcaagccatcgggacaattcgtaatggcagacttacagaagtacggtggtactccagccgtgatgaaattcttgatgaacgaaggcttcattgacggagaccagtacactgtcactggtaagaccatcaaggaaaatttggcttccgtcaaggacttgcctgctgatcagcctatcatcagaccagtcagcaaccccttgaagacaagcggtcacttgcaaatcttgaagggttccttggctccaggttctgctgtcggtaagatcaccggtaaggaaggtacctacttcaagggtaaggctcgtgtctttgatgacgaaggagacttcattgtcgccttggagaagggtgagattaagaagggtgaaaagaccgtctgtgtcatcagatacgaaggtccaaaaggaggccccggtatgcctgaaatgttgaagccttcctcggccttgatgggttatggtttaggtaaagatgttgctcttttgacagacggtaggttctctggtggatcccacggcttcttgattgggcacattgttcctgaagctgctgaaggtggacctatcggtttggtgtacgatggtgacgaaatcgtcattgatgccgaaaacaacaagatcgacttgttagtagacgaagctgtgttggctgaaagaagaaagttatggactgctcctgagccaagatacaccaggggtactttggccaagtacgccagattggtcagtgacgcttctgctggatgcgttaccgacttgccaataaagaattaa

SEQ ID NO: 396 - protein, 604 aa, Pichia stipitis
MSFLFKAAAARRVASKSPAAVARSFSVSATQCEKKLNKYSSIVTGDPSQGASQAMLYATGFDDADFNRAQIGVGSVWWSGNPCNMHLMELNNKCTESVNRAGLKGMQFNSIGISDGITNGTEGMRYSLQSREIIADSFESMMLGQLYDGNIAIPSCDKNMPGVLIAMARHNRPSIMVYGGTILPGQTTCGTNNPAIADKIDIISAFQSYGQYLTKSITNEERKDIVRHACPGPGACGGMYTANTMASAAECLGMSLPYSSSAPAVSKEKDAECANIGQAIKHLLEIDLKPRDILTKKSFENAIAYIIATGGSTNAVLHLIAIASSADIDLTVDDFQRISDSTPLLADFKPSGQFVMADLQKYGGTPAVMKFLMNEGFIDGDQYTVTGKTIKENLASVKDLPADQPIIRPVSNPLKTSGHLQILKGSLAPGSAVGKITGKEGTYFKGKARVFDDEGDFIVALEKGEIKKGEKTVCVIRYEGPKGGPGMPEMLKPSSALMGYGLGKDVALLTDGRFSGGSHGFLIGHIVPEAAEGGPIGLVYDGDEIVIDAENNKIDLLVDEAVLAERRKLWTAPEPRYTRGTLAKYARLVSDASAGCVTDLPIKN

SEQ ID NO: 397 - DNA, 1705 bp, Yarrowia lipolytica
ctacgctactaaggcgcacactttgaacaagttctccaagatcatcacggagcccaagtcgcagggagcctctcaggctatgctgtacgcctgcggcttcaacgaggccgatctgggcaagccccaggttggtgtcgcctccgtctggtggtccggaaacccctgcaacatgcacctgcttgatctcaacttcaaggtcaaggagggcatcgagaagcacaacctcaaggccatgcagttcaacactattggtgtgtctgatggtatttctatgggtaccaagggtatgcgatattctctgcaatctcgagacatgattgctgactccattgagactctcatgatggcccagcactacgacgccaacatctccatcccgggctgtgacaagaacatgcccggtgttctcatggccatgggccgagtcaaccgaccctccatcatgctgtacggaggaaccatccaccccggaaaggccgagactcgaaagggcgaggacattgatattgtttccgccttccaggcctacggacagtacattgccggcggcatctctgagaccgagcgagccgatgttattcgacacgcctgccccggtcagggagcctgtggaggtatgtacactgctaacaccatggcttctgccgcagaggtgcttggtatgactctgcctggctcctcctccgctcccgccatctccaaggagaagatggccgagtgtgaggctctgggacctgccatcaacaagctgctggagatggacctcaagcctaaggatatcatgacccgacaggcctttgagaacgctattgcttacatcattgccactggaggctccaccaacgccgttctccatctgctggctatcgctcacaccgtcgacgttcctttgaccattgacgacttccagcgaatctccgataacactcctctgctcgccgacttcaagccctccggagctcacgtcatggccgatctgcagaagtggggtggaacccccgccgtcatcaagatgctcattgagcagggtttcattgatggctctcccatgacctgttccggagagtctctcaaggacaccgtcgccaagtacccctctctccccaaggagcaggatatcttcgcctctgttgacgctcccctcaagccctctggtcatctgcagattcttaagggctcccttgctcccggtggatccgtcggaaagatcaccggaaaggagggaacattcttcaagggtaccgcccgatgtttcgacgaggaggacctgttcattgaggctctggagaagggcgagatcaagaagggcgagaagacctgtgtcattattcgatacgagggccccaagggaggacccggtatgcccgagatgctcaagccctcttctgccctgatgggatacggtctgggcaaggatgttgctctgctgaccgacggacgattctccggaggatctcatggtttcctcattggtcacattgtccccgaggcttacgagggaggtcccattggtctggttgaggacggcgatgagatcatcatcgacgctgacaacaacatcatcgacctgcttgttgatgagaagaccatggctgagcgaaaggccaagtggactccccccgctcctcgatacacctctggaaccctgcacaagtactccaagcttgtgtccgacgcctccactggctgtatcactgacgcctaa

SEQ ID NO: 398 - protein, 567 aa, Yarrowia lipolytica
YATKAHTLNKFSKIITEPKSQGASQAMLYACGFNEADLGKPQVGVASVWWSGNPCNMHLLDLNFKVKEGIEKHNLKAMQFNTIGVSDGISMGTKGMRYSLQSRDMIADSIETLMMAQHYDANISIPGCDKNMPGVLMAMGRVNRPSIMLYGGTIHPGKAETRKGEDIDIVSAFQAYGQYIAGGISETERADVIRHACPGQGACGGMYTANTMASAAEVLGMTLPGSSSAPAISKEKMAECEALGPAINKLLEMDLKPKDIMTRQAFENAIAYIIATGGSTNAVLHLLAIAHTVDVPLTIDDFQRISDNTPLLADFKPSGAHVMADLQKWGGTPAVIKMLIEQGFIDGSPMTCSGESLKDTVAKYPSLPKEQDIFASVDAPLKPSGHLQILKGSLAPGGSVGKITGKEGTFFKGTARCFDEEDLFIEALEKGEIKKGEKTCVIIRYEGPKGGPGMPEMLKPSSALMGYGLGKDVALLTDGRFSGGSHGFLIGHIVPEAYEGGPIGLVEDGDEIIIDADNNIIDLLVDEKTMAERKAKWTPPAPRYTSGTLHKYSKLVSDASTGCITDA

SEQ ID NO: 399 - DNA, 1752 bp, Candida glabrata
atgtcctccagactaacttttgctaggaagttctccagcacaagaaatgttgcaaagaaactgaataaatactcatatatcatcactgagcctaaggaccaaggtgcctctcaggctatgttgtatgccactggtttcaacaaggatgatttcagcaaagcgcaagttggtgttggttcttgttggtggtctggtaacccatgtaacatgcatctattggatttgaaccacagatgttcccaatccatcgagaaagccggtatgaaaggtatgcaatttaacacaattggtgtctctgacggtatctcgatgggtactaaaggtatgagatattctttacaaagtagagaaattatcgcagactctttcgagactatcatgatggcacaacactacgatgccaatattgctattccatcctgtgacaagaatatgcctggtgttatgatggctatgggtagacacaacagaccatctattatggtttatggtggtaccattatgccaggtcacccaacttgtggctccaagaacattccagagaacattgatgttgtctctgctttccaatcctacggtcaatacatctcgaagcaattcaatgaagaagagagaagtgatgttgtacaacactcttgtccaggtcctggctcttgtggtggtatgtacaccgccaacaccatggcctctgctgccgaagttttaggtatcactatgccaaactcttctgctttcccagctgtttctgctgaaaagattgctgaatgtgacaacattggtgctgctatcaagaacactatggaacttggtattaccccacgtcaaatcttcaccaaggaatcctttgaaaacgctatcacttacgtcattgctactggtggttccactaacgcagttcttcacttggtagctattgcacactctgctggtgtcaagatcaccccagatgatttccaaaggatcagtgacaagacaccattgctaggtgacttcaagccatctggtaagtatgtcatggccgatttgattaaggtcggtggtactcaaagtgtcatcaagttcttgtatgacaacggtttcttatacggtgacgccttaactgttactggtgaaactttggctgagcgtgccaagaaagccaagggtctaagtgaaactcaagacattattagaccattgtcaaacccaattaagccaagtggccatctacaaattctatacggttctcttgctccaggtggttctgttggtaagattactggtaaggaaggtacttacttcaaaggtaaggctcgtgttttcgaagaagaagacgctttcatctctgcattggagaatggtgaaatcaagaaaggtgaaaagacagttgttattatcagatatgaaggtccaaagggtggtccaggtatgccagaaatgttgaagccatctagtgcactaatgggttatggtctaggtaaagatgttgccttgctaactgatggtagattctctggtggttctcatggtttcttgattggtcacattgttccagaagctgccgaaggtggtccaattggtttggtcagagatggtgatgaaattgtgattgatgcagacaacaacaagattgacctcctaatctctgaatctgagatgtctcaacgtaaggccgaatggaaacctccagccccacgttacaacaggggtactctatccaaatatgctaagttagtctctaatgcctcccaaggttgtgttacagacgcttaa

SEQ ID NO: 400 - protein, 583 aa, Candida glabrata
MSSRLTFARKFSSTRNVAKKLNKYSYIITEPKDQGASQAMLYATGFNKDDFSKAQVGVGSCWWSGNPCNMHLLDLNHRCSQSIEKAGMKGMQFNTIGVSDGISMGTKGMRYSLQSREIIADSFETIMMAQHYDANIAIPSCDKNMPGVMMAMGRHNRPSIMVYGGTIMPGHPTCGSKNIPENIDVVSAFQSYGQYISKQFNEEERSDVVQHSCPGPGSCGGMYTANTMASAAEVLGITMPNSSAFPAVSAEKIAECDNIGAAIKNTMELGITPRQIFTKESFENAITYVIATGGSTNAVLHLVAIAHSAGVKITPDDFQRISDKTPLLGDFKPSGKYVMADLIKVGGTQSVIKFLYDNGFLYGDALTVTGETLAERAKKAKGLSETQDIIRPLSNPIKPSGHLQILYGSLAPGGSVGKITGKEGTYFKGKARVFEEEDAFISALENGEIKKGEKTVVIIRYEGPKGGPGMPEMLKPSSALMGYGLGKDVALLTDGRFSGGSHGFLIGHIVPEAAEGGPIGLVRDGDEIVIDADNNKIDLLISESEMSQRKAEWKPPAPRYNRGTLSKYAKLVSNASQGCVTDA

SEQ ID NO: 401 - DNA, 1815 bp, Chlamydomonas reinhardtii
atgtcgtcgactgcgaccatgcccggccagcgctcggccatgaaggccgctggcgcccagagccgccgtgccgtgaaggtgatggccgtgtccgctccggagaagccgtcgtcgtccgccccggccgtcccggcaggcctgaacaagttcagcagccgcatcacgcaacccaagtaccagggcgcgtctcaggccatgctgttcgctaccggtctgcgggaggaggacatgatcaagccgcaggtgggcatctcctcggtgtggtacgagggcaacccttgcaacatgcacctgatggacctggcggcggaggtgaagaagggcgtggaggccatgggcatggtgggcttccgcttcaacaccattggtgtcagcgacggcatttccatgggcaccgacggcatgagcttcagcctgcagagccgcgacctgattgccgactccattgagacggtcatgagcgcgcagtggtacgacgccaacatctcgctgcccggctgcgacaagaacatgcccggcacgctgatggccatggcccgcctgaaccgcccctcgctcatgatctacggcggcactatcaagcccggccacagccgcatggacggctccgtgctggacatcgtgtccgccttccagagctacggcgcctactcggccggcctgatcaacgaggcccagcgtgtggacattgtgcgcaacagctgccctggcgctggcgcgtgcggcggcatgtacactgccaacaccatggcctcggccattgaggctctgggcatgaccctgccctacagctcgtccatccccgctgaggacccgctgaagaaggacgagtgccgcatggccggccgctacatgctggagctgctcaagtccgacctgaagcctctggacatcatgacctacaaggcctttgagaacgccatggtgctggtcatggccaccggcggctccaccaacgccgtgctgcacttcatcgccatggcgcgcgcctgcggcgtgcccctgaccctggacgacttccagcgcgtgtctgaccgcacgcccttcatctgcgacctcaagccctcgggccgctacgtcatggaggacatccacaaggtgggcggcacccccgccgtgctgaagtacctggactccaagggctacatcaaccgcgactgcatgaccgtcactggcaagaccatgggcggcaacctggcggaggtgccggagctgcgtgcgggccaggacgtggtgctgcccgtggagaagcccatcaagcagactggccacatccagatcctgtacggcaacctggccccggagggcagcgtggccaagatcactggcaaggagggcctgctgttcgagggcgaggcgctggtgtttgacaacgaggaggacatgatcaccatggtgggcgccgagcccaacaagttccgcggcaaggtggtggtgatccgctacgagggccccaagggcggccccggcatgcccgagatgctcacgcccacctccgccatcatgggcgccggcctgggcaaggagtgcgcgctcatcaccgacggacgcttcagcggcggcagccacggcttcgtgatcggccacgtcacgcccgaggcgcaggtcggcggccccatcgccctggtcaagaacggcgacaagattgtgattgatgtggagaagcgcgtgatggacatgaagatctccgaccaggagctggccgcgcgcaaggctgcctggaaggcgcccccgctgaaggccaccagcggcaccctgtacaagtacatcaagaacgtgtcgtcggcgtccactggctgcgtcaccgactcgtaa

SEQ ID NO: 402 - protein, 604 aa, Chlamydomonas reinhardtii
MSSTATMPGQRSAMKAAGAQSRRAVKVMAVSAPEKPSSSAPAVPAGLNKFSSRITQPKYQGASQAMLFATGLREEDMIKPQVGISSVWYEGNPCNMHLMDLAAEVKKGVEAMGMVGFRFNTIGVSDGISMGTDGMSFSLQSRDLIADSIETVMSAQWYDANISLPGCDKNMPGTLMAMARLNRPSLMIYGGTIKPGHSRMDGSVLDIVSAFQSYGAYSAGLINEAQRVDIVRNSCPGAGACGGMYTANTMASAIEALGMTLPYSSSIPAEDPLKKDECRMAGRYMLELLKSDLKPLDIMTYKAFENAMVLVMATGGSTNAVLHFIAMARACGVPLTLDDFQRVSDRTPFICDLKPSGRYVMEDIHKVGGTPAVLKYLDSKGYINRDCMTVTGKTMGGNLAEVPELRAGQDVVLPVEKPIKQTGHIQILYGNLAPEGSVAKITGKEGLLFEGEALVFDNEEDMITMVGAEPNKFRGKVVVIRYEGPKGGPGMPEMLTPTSAIMGAGLGKECALITDGRFSGGSHGFVIGHVTPEAQVGGPIALVKNGDKIVIDVEKRVMDMKISDQELAARKAAWKAPPLKATSGTLYKYIKNVSSASTGCVTDS

SEQ ID NO: 403 - DNA, 1704 bp, Ostreococcus lucimarinus
atgcccgacggcgacgcgagcgatttgaacaagtggtcgagaaagatcacgcaaccgaagagccaaggagcgtcgcaggcgatgctgtacgccacgggcctgacggaggccgatatgaacaaaccgcagatcggcgtgtcctcggtgtggtggcagggaaacccttgtaacaaacacttgctggacctggcgggtaaagtggcggaaggcgtcaaggcggcggatatggtgagctttcagtttaacaccgtgggggtgtcggacgggatttccatgggtacgccgggcatgtccttctcgttgcaatcgcgggatttgatcgcggatagcatcgagaccgtgatgggtggacagtggtacgacggaaatatttctctcccggggtgcgataagaacatgccgggtacgatcatggccatgggtcgattgaaccgcccgtcgctgatgatttacggcggtaccattcgccctggccactccgccgtggatggtggcacactcgatatcgtatccgcgttccaatcgtacggacagttcgttaccggcgctatcacggaggaacagcgcaaagacatcgtgcgtaactcttgcccgggctctggcgcgtgcggcggcatgtacaccgccaacaccatggccagctgcatcgaggctctcggcatgactcttccgtattcttcctccattcccgcggaagatcctctcaagatggatgaatgtttcatggctggcgctgcgatgaagcatttgctcgaaatcgacctgaagccgcgtgacatcatgactcgcgcggcgttcgaaaacgccatggtcaccgtcatcgctctcggcggttccaccaacgcggttcttcacttgatcgcgatggcgcactctgtcggcatcaaattgactctggacgacttccaagccgtctccaacaagacgccgttcatcgctgacttaaagccgtccggtaagtacgtcatggaggacgtccacaaggttggcggcactccggcggtgttgaagtatttgatgtctgaaggcatgattgacggttcttgcatgactgtcaccggtaagaccctcgccgagaacctcgccatctgcccggatttgacgccggggcaagatgttattctcccggtgagcacgcccatcaagaagactggtcacttgcaatgcttgtacggcaacatcgcccagggaggctccgtggcgaagatcaccggtaaggaaggcttgtactttaaaggcttcgcgaagtgctacgatagcgaagaggaaatgctcgaggccttggcggcagactccgagtctttcaagggtagcgtcatcgtcattcgctacgaaggtccgaagggtggtccgggcatgccggagatgctcacgccgacgtcggccatcatgggtgccggtctcgggaacgactgcgcgctcatcacggatggtcgattctccggtggctcgcacggtttcgtcatcggtcacgttacgccggaagcgcaagttggtggtaacatcggtttgatcaaggacggtgatatcatcgaaattgatgccgaagttcgcaccatcaacgcgccggatgtcaccgacgccgagtgggaaaagcgtcgagcggcgtggaaggcgccgcctttggaagcgacgtcgggtacgctctacaagtactgcaagctcgtcgccagcgcttcggaaggctgcatcacggacttgtga

SEQ ID NO: 404 - protein, 567 aa, Ostreococcus lucimarinus
MPDGDASDLNKWSRKITQPKSQGASQAMLYATGLTEADMNKPQIGVSSVWWQGNPCNKHLLDLAGKVAEGVKAADMVSFQFNTVGVSDGISMGTPGMSFSLQSRDLIADSIETVMGGQWYDGNISLPGCDKNMPGTIMAMGRLNRPSLMIYGGTIRPGHSAVDGGTLDIVSAFQSYGQFVTGAITEEQRKDIVRNSCPGSGACGGMYTANTMASCIEALGMTLPYSSSIPAEDPLKMDECFMAGAAMKHLLEIDLKPRDIMTRAAFENAMVTVIALGGSTNAVLHLIAMAHSVGIKLTLDDFQAVSNKTPFIADLKPSGKYVMEDVHKVGGTPAVLKYLMSEGMIDGSCMTVTGKTLAENLAICPDLTPGQDVILPVSTPIKKTGHLQCLYGNIAQGGSVAKITGKEGLYFKGFAKCYDSEEEMLEALAADSESFKGSVIVIRYEGPKGGPGMPEMLTPTSAIMGAGLGNDCALITDGRFSGGSHGFVIGHVTPEAQVGGNIGLIKDGDIIEIDAEVRTINAPDVTDAEWEKRRAAWKAPPLEATSGTLYKYCKLVASASEGCITDL

SEQ ID NO: 405 - DNA, 1695 bp, Vitis vinifera
atgcaagcagctctgataaccccttctcctcgcgccattcccaccggttccatcactgccacgagaaccacaattccccctcatgtgcgcctcgtgtctgtccgagcatcgaccgaggtagcccaatcgccgccacccgcagtgaaagagacggcccacaagctcaacaagtacagctctcatgtcaccgagcccaagtcccagggcggctcacaagccatcctctatggcgtgggtctctcggatgaggacatgcacaagcctcaaatcggtatatcatcggtttggtacgagggcaacacctgcaacatgcatttgttgaagctttcagaggctgtgaaggagggggtgagagatgccggcatggttgggttcaggttcaacactgttggtgtcagcgatgccatctcaatgggcacgagaggcatgtgctatagcttgcagtctagggatttgattgctgatagtattgagacggtcatgtctgctcagtggtatgatggcaacatttctattcccggttgtgacaaaaatatgccaggtacaataatggcaatgggacggctcaatcgacctagtattatggtttatggtggagctatcaagcctggtcattttcaaggccatacttacgacataatatctgcctttcaggtttatggagagttcgtcagtgggtccataactgatgaacagaggatgaatgttgtccgaaattcatgcccaggagcaggagcttgtggtggaatgtatacagccaatacgatggcttctgctattgaagttatgggaatgtctcttcccttcagctcttcaacaccggctgaagacccattgaagttgcatgagtgccatttggctggaaaatatcttctggatttgataaaaatggacttaaaaccacgagatattatcactatgaagtcactacggaatgctatggttgttgtcatggcattgggtggatctaccaatgctgtattacatttaattgccattgcaaggtctgttggtctgcagttaactcttgatgattttcagaaagtaagtgatgaggttccattccttgctgatcttaagcccagtggcaaatacgtcatggaggacatacacaagattggaggaacaccggcaatcattcgcttccttttggaaaatgggtttttagatggggattgtataacagttactgggaagacattggctgaaaatgcagaactttttccttctttgcccagagatcagcaaataataagaccgttggcaaaccccataaagaagactggacacctccaaactttatatggaaatcttgcaccagagggttctgttgcaaaaattactggaaaagaagggctatatttctctggtcctgcacttgtctttgaaggtgaggaagctatgattgcagctatagcagagaatcctatgagctttaaggggaaagtagttattattagaggagagggacccaagggggggccaggaatgcctgaaatgttgactccaacaagcgcaataatgggagcaggtcttgggaaggatgttgctttgttgactgatggtaggttttcaggaggttcacatggatatgttgttggccacatatgtcctgaagcacatgtacattttcttttccttcatccagttttatttttttatttttttgatcagaaacgaagaagattatattaa

SEQ ID NO: 406 - protein, 564 aa, Vitis vinifera
MQAALITPSPRAIPTGSITATRTTIPPHVRLVSVRASTEVAQSPPPAVKETAHKLNKYSSHVTEPKSQGGSQAILYGVGLSDEDMHKPQIGISSVWYEGNTCNMHLLKLSEAVKEGVRDAGMVGFRFNTVGVSDAISMGTRGMCYSLQSRDLIADSIETVMSAQWYDGNISIPGCDKNMPGTIMAMGRLNRPSIMVYGGAIKPGHFQGHTYDIISAFQVYGEFVSGSITDEQRMNVVRNSCPGAGACGGMYTANTMASAIEVMGMSLPFSSSTPAEDPLKLHECHLAGKYLLDLIKMDLKPRDIITMKSLRNAMVVVMALGGSTNAVLHLIAIARSVGLQLTLDDFQKVSDEVPFLADLKPSGKYVMEDIHKIGGTPAIIRFLLENGFLDGDCITVTGKTLAENAELFPSLPRDQQIIRPLANPIKKTGHLQTLYGNLAPEGSVAKITGKEGLYFSGPALVFEGEEAMIAAIAENPMSFKGKVVIIRGEGPKGGPGMPEMLTPTSAIMGAGLGKDVALLTDGRFSGGSHGYVVGHICPEAHVHFLFLHPVLFFYFFDQKRRRLY

SEQ ID NO: 407 - DNA, 1839 bp, Vitis vinifera
atgcaagtagctctgataaccccttctcctcgcgccattcccaccggttccatcactgccacgagaaccacaattccccctcatgtgcgcctcgtgtctgtccgagcatcgaccgaggtagcccaatcgccgccacccgcagtgaaagagacggcccacaagctcaacaagtacagctctcatgtcaccgagcccaagtcccagggcggctcacaagccatcctctatggcgtgggtctctcggatgaggacatgcacaagcctcaaatcggtatatcatcggtttggtacgagggcaacacctgcaacatgcatttgttgaagctttcagaggctgtgaaggagggggtgagagatgccggcatggttgggttcaggttcaacactgttggtgtcagcgatgccatctcaatgggcacgagaggcatgtgctatagcttgcagtctagggatttgattgctgatagtattgagacggtcatgtctgctcagtggtatgatggcaacatttctattcccggttgtgacaaaaatatgccaggtacaataatggcaatgggacggctcaatcggcctagtattatggtttatggtggagctatcaagaggcagattgacaattataattgggatcccaatcataccatcctgtgtagtgtggcacaccactttatactgagatatgaaatgttgtatgaagtcatctttgagaaatggcatgatcctggtcattttcaaggccatacttacgacataatatctgcctttcagctatggtctgaaggaggtgtatgtgtagtatcacttgtcccatggtttatggagagttcgtccagtgggtccataactgatgaacagaggatgaatgttgtccgaaattcatgcccaggagcaggagcttgtggtggaatgtatacagccaatacgatggcttctgctattgaagttatgggaatgtctcttcccttcagctcttcaacaccggctgaagacccattgaagttgcatgagtgccatttggctggaaaatatcttctggatttgataaaaatggacttaaaaccacgagatattatcactatgaagtcactacggaatgctatggttgttgtcatggcattgggtggatctaccaatgctgtattacatttaattgccattgcaagaattgctcatgataagattcttggcaggtctgttggtctgcagttaactcttgatgattttcagaaagtaagtgatgaggttccattccttgctgatcttaagcccagtggcaaatatgtcatggaggacatacacaagattggaggaacaccggcaatcattcgcttccttttggaaaatgggtttttagatggggattgtataacaggtcctgcacttgtctttgaaggtgaggaagctatgattgcagctatagcagagaatcctatgagctttaaggggaaagtagttattattagaggagagggacccaaggggggcccaggaatgcccgaaatgttgactccaacaagcgcaataatgggagcaggtcttgggaaggatgttgctttgttgactgatggtaggttttcaggaggttcacatggatatgttgttggccacatatgtcctgaagcacatgaaggtggtcccattggtctcattgaaaatggagatatcatcacaattgatgtccaaaaaaggagaatggatgtccagctgacagatgaagagatgaatgagcgaagaaagaaatggagtcccccaccatataaggctaaccaaggagttctatacaagtacatcaagaacgtaaaatcggcttcagatgggtgtgtgacggatgaataa

SEQ ID NO: 408 - protein, 612 aa, Vitis vinifera
MQVALITPSPRAIPTGSITATRTTIPPHVRLVSVRASTEVAQSPPPAVKETAHKLNKYSSHVTEPKSQGGSQAILYGVGLSDEDMHKPQIGISSVWYEGNTCNMHLLKLSEAVKEGVRDAGMVGFRFNTVGVSDAISMGTRGMCYSLQSRDLIADSIETVMSAQWYDGNISIPGCDKNMPGTIMAMGRLNRPSIMVYGGAIKRQIDNYNWDPNHTILCSVAHHFILRYEMLYEVIFEKWHDPGHFQGHTYDIISAFQLWSEGGVCVVSLVPWFMESSSSGSITDEQRMNVVRNSCPGAGACGGMYTANTMASAIEVMGMSLPFSSSTPAEDPLKLHECHLAGKYLLDLIKMDLKPRDIITMKSLRNAMVVVMALGGSTNAVLHLIAIARIAHDKILGRSVGLQLTLDDFQKVSDEVPFLADLKPSGKYVMEDIHKIGGTPAIIRFLLENGFLDGDCITGPALVFEGEEAMIAAIAENPMSFKGKVVIIRGEGPKGGPGMPEMLTPTSAIMGAGLGKDVALLTDGRFSGGSHGYVVGHICPEAHEGGPIGLIENGDIITIDVQKRRMDVQLTDEEMNERRKKWSPPPYKANQGVLYKYIKNVKSASDGCVTDE

SEQ ID NO: 409 - DNA, 1827 bp, Arabidopsis thaliana
atgcaagccaccatcttctctccacgcgccactctcttcccctgtaaacctctcctcccttcccacaatgtcaactctcgccgtccctcaatcatctcctgctccgcccaatccgtaaccgctgatccttcaccacctatcactgacaccaataagctcaacaaatacagctcaagaatcactgaacccaaatcccaaggtgggtctcaagcaattcttcacggtgttggtttatcagacgacgatttgctaaaaccccagattggtatctcgtcggtttggtatgaagggaacacttgtaacatgcatttgctgaaattgtctgaggctgtgaaagaaggagttgaaaatgcaggaatggttgggtttaggtttaatactattggtgtgagtgatgctatttcgatgggaacgagagggatgtgttttagtttgcaatctagggatttgattgctgatagtattgagactgttatgagtgctcagtggtatgatggtaacatatctattcccggttgtgataaaaatatgcctggaactattatggctatgggaaggcttaacagaccagggattatggtttatggtggaaccattaagcctggccattttcaagacaagacatatgacattgtatctgctttccagagttatggagaatttgttagtggctccataagtgatgaacagagaaagactgtcctccatcattcatgtcctggagctggagcctgtggtggcatgtacacagcgaatacaatggcttctgctatcgaagcaatgggaatgtcccttccttacagttcttcaatacctgctgaagacccattgaagttggacgagtgtcgcttagcaggaaaatatcttctagaattgctaaagatggacttaaaaccccgtgacattatcactccaaaatcacttcgtaatgcaatggtttccgtcatggcccttgggggatcgacaaatgcagtattgcatctaattgctattgcaaggtctgttggtttggagttgactcttgacgattttcagaaagttagcgatgcggttccatttctagcagatcttaaacccagtgggaagtatgttatggaggatatacataagataggtggtacgccagctgttctccgctatttattagagctaggattgatggatggtgattgtatgacagtgacagggcagactttggctcaaaatttagaaaacgtcccaagcttaacagaagggcaggagataattagacctctgtcaaatccaatcaaggagactggacacatacaaattttgagaggagaccttgcaccagatggttctgtagcaaaaattaccggcaaagagggcttatatttctctggtcctgcacttgtatttgaaggagaggaatctatgttggctgctatatcagcagacccaatgagttttaagggaactgtggttgttatcagaggagaggggcctaaaggaggtccaggtatgcctgagatgttgacaccgacaagtgcaataatgggtgccggtcttggaaaggaatgtgcattactgactgatggtaggttctctggtgggtcacacggttttgttgttggccacatttgccctgaagctcaggagggtggtccgatcggtctgatcaagaacggagacataatcaccattgacataggaaagaagagaatagacacacaagtctcacccgaagaaatgaatgaccgtagaaagaaatggactgctcctgcatacaaggttaaccgcggagtcctatataagtacatcaagaacgtgcaatcggcttcagatggatgtgtgactgacgagtaa

SEQ ID NO: 410 - protein, 608 aa, Arabidopsis thaliana
MQATIFSPRATLFPCKPLLPSHNVNSRRPSIISCSAQSVTADPSPPITDTNKLNKYSSRITEPKSQGGSQAILHGVGLSDDDLLKPQIGISSVWYEGNTCNMHLLKLSEAVKEGVENAGMVGFRFNTIGVSDAISMGTRGMCFSLQSRDLIADSIETVMSAQWYDGNISIPGCDKNMPGTIMAMGRLNRPGIMVYGGTIKPGHFQDKTYDIVSAFQSYGEFVSGSISDEQRKTVLHHSCPGAGACGGMYTANTMASAIEAMGMSLPYSSSIPAEDPLKLDECRLAGKYLLELLKMDLKPRDIITPKSLRNAMVSVMALGGSTNAVLHLIAIARSVGLELTLDDFQKVSDAVPFLADLKPSGKYVMEDIHKIGGTPAVLRYLLELGLMDGDCMTVTGQTLAQNLENVPSLTEGQEIIRPLSNPIKETGHIQILRGDLAPDGSVAKITGKEGLYFSGPALVFEGEESMLAAISADPMSFKGTVVVIRGEGPKGGPGMPEMLTPTSAIMGAGLGKECALLTDGRFSGGSHGFVVGHICPEAQEGGPIGLIKNGDIITIDIGKKRIDTQVSPEEMNDRRKKWTAPAYKVNRGVLYKYIKNVQSASDGCVTDE

SEQ ID NO: 411 - DNA, 1785 bp, Oryza sativa
atgcagtcgcttgccctcacctccccctcccttccggcgccggcgaccgcatccggccgccgccgccgccgcctggagcgcatccgcgccaccgcggtgtccgacgagccgaagctgaacaagtacagcgcgcgcatcacggagcccaagtcgcagggggcgtcgcaggcggtgctctacggcgtggggctcaccgacgccgacctccgcaagccgcaggtgggcgtctcctctgtctggtacgagggcaacacctgcaacatgcaccttctccgcctcgccgaggccgtcagggacggcgtccgcgaggccggcatggtggccttccgcttcaacaccgtcggggtcagcgacgccatctccatgggcacccggggcatgtgctacagcctccagtcgcgcgacctcatcgccgacagcatcgagaccgtcatgggcgcgcagcactacgacgccaacatctccattcctggatgcgacaagaacatgccaggaacaataatggcaatggggcggctgaaccgaccaagtatcatgatatatggtggaactattaagcctggtcattttcagggtaattcttatgacatagtatctgctttccagtgctatggagaatttgttaccggatcaatcagtgatgagcaaagaaagaatgtgctccgcaactcatgcccaggagcaggtgcgtgtggtggtatgtacaccgcgaacacaatggcatccgccatcgagaccatgggtatgagccttccgtacagttcttcaacccctgctgaagacccactaaagctagaggaatgccgtcttgctgggaagtatcttttagaattgttaaagatggatttgaagcctgaagacattatcactgagaaatctttgcggaacgcaatggtcattgtcatggcacttggtgggtctactaatgctgttttgcatttaattgctatcgctaggtctgtaggtctgcaattaactcttgatgattttcagaaggtcagtgaccaagttcctttccttgcggaccttaagcctagtggcaaatatgtcatggaggatctgcataagattggtggaacacctgcagtaattcattatcttctggagcaaggtcttcttgatggtgattgtatgaccgtcactgggaaaactctagcggaaaatgctaaaatcttccctcctctgtccgaaggacagcaaataataaggcccctggacaacccaatcaaatcaactggtcatatacaaatactttatggcaatcttgcaccagaaggttctgtagcaaaaattactggcaaagaggggatgtttttctcaggccctgcactagtgtttgagggtgaagaatctatgattacagctatatcagaaaacccagcgaatttcaaggggaaggtagtagtgatacgaggagaaggaccgaaaggtggaccagggatgcctgaaatgctgactccaactagtgcaataatgggtgctggtcttgggaaggagtgtgccctgctgaccgatggcagattttctggaggatcacatggatttgttgtaggccacatttgtcctgaagcacaggagggaggtccaattggtcttgttcaaaacggtgacaaaattaccattgatgttgtgaagagagtaattgatgttgaactgactgaagctgagctggaagaaagacggaggaaatggacgccgccgccacacaaggctgcccgtggagcgctttggaagtacacgaagctcgtgtcccctgcatcaagaggatgcgtcaccgatgagtag

SEQ ID NO: 412 - protein, 594 aa, Oryza sativa
MQSLALTSPSLPAPATASGRRRRRLERIRATAVSDEPKLNKYSARITEPKSQGASQAVLYGVGLTDADLRKPQVGVSSVWYEGNTCNMHLLRLAEAVRDGVREAGMVAFRFNTVGVSDAISMGTRGMCYSLQSRDLIADSIETVMGAQHYDANISIPGCDKNMPGTIMAMGRLNRPSIMIYGGTIKPGHFQGNSYDIVSAFQCYGEFVTGSISDEQRKNVLRNSCPGAGACGGMYTANTMASAIETMGMSLPYSSSTPAEDPLKLEECRLAGKYLLELLKMDLKPEDIITEKSLRNAMVIVMALGGSTNAVLHLIAIARSVGLQLTLDDFQKVSDQVPFLADLKPSGKYVMEDLHKIGGTPAVIHYLLEQGLLDGDCMTVTGKTLAENAKIFPPLSEGQQIIRPLDNPIKSTGHIQILYGNLAPEGSVAKITGKEGMFFSGPALVFEGEESMITAISENPANFKGKVVVIRGEGPKGGPGMPEMLTPTSAIMGAGLGKECALLTDGRFSGGSHGFVVGHICPEAQEGGPIGLVQNGDKITIDVVKRVIDVELTEAELEERRRKWTPPPHKAARGALWKYTKLVSPASRGCVTDE

SEQ ID NO: 413 - DNA, 1767 bp, Physcomitrella patens
atggtggtggcgtcgtcgagcgcggaaggggctgtggccgcgccgcccccgcagtccgtggaggcgccggctgggagcgccacggacagcgcgaagctgaacaagtactcaagccgcgtgacccagcctaaggcgcagggcgcctcgcaggcgattctgtacggggtggggttgtccgaggaggatatgaacaagccgcaggtgggaatctcgtcggtttggtacgagggcaacacgtgcaatatgcatttgctgcatttgtctgaggctgtgaaggagggggtgaaggaggccgggatggtggggttccgattcaacactgtgggagttagtgacgccgtgtccatgggaaccgaggggatgtgctacagcctgcagtcgcgcgatttgattgcggacagtgtggagactgttatgggcgggcagtggtacgacgccaacatttccattccggggtgtgataagaacatgcccggggtggtcatggccatggggcggctgaacaggcccagcattatgatttatgggggcaccatcaagccaggtcattttaacggacagacgctcgacatcgtttcagccttccagagctacggagagtatgtgagcgggtccatctccgaggatgagaggatggacgttgtaaggaattcttgccccggattcggagcttgtggaggaatgtacaccgccaacaccatggcgtccgccattgaagcgctaggcatgtcgctgccgtacagctcttccatccccgccgaggacccgttgaagatcgaggaatgcaaattggccgggaaatacattctggagcttctaaagcgtgacttgaagccgcgtgacattatcacccgaaagtcgctcaacaacgctatggtggttgtcatggcgctcggaggttccacgaatgcggtgcttcatctcatcgccatcgctcgttctgtgggcgttgagctcacattggacgatttccaggacgtgagcgacaagaccccgttcattgctgatcttaaacctagcgggaagtacgtgatggaggatttgcacaaaattggaggcgtgcctgccgtactgaagtacttgttagaaaaagggctaatcgacgggagctgcatgacagtcacggggaagaccatcgctgagaacctcgctgagtgcccgcccctctccgaaggtcagaagatcatcatgcctctcgaaaaccccatcaaaaaaactggtcacttgcaaattctgtggggcaaccttgctccagagggttccgttgctaaaattacaggcaaagaaggcttgtacttttctggccccgcccgtgtatttgagggagaggaagccatgctggacgctatcactgaggaccctcagagcttgaagggtactgtgatcgttatccgaggggagggtcctaagggtggcccgggcatgcctgagatgctcacccccacgagtgctgtaattggagctggacttggcaaggaagtagcgcttctgaccgacggtcgattctctggtggctctcacggcttcgttgttgggcacatctgcccagaagctcaagtaggtggcccgattgggcttgtacgtgatggagacgtgatcaccatcgacgtggagaagaggaaaatcaacgtcgatttgacggcacaagagcttgcggatcgaaaactcctgtggagagctcccccttacaaggcctctcgtggaaccctttacaagtacatcaagaatgtcaaatcagcgtccgaaggttgcgtgactgatgagtga

SEQ ID NO: 414 - protein, 588 aa, Physcomitrella patens
MVVASSSAEGAVAAPPPQSVEAPAGSATDSAKLNKYSSRVTQPKAQGASQAILYGVGLSEEDMNKPQVGISSVWYEGNTCNMHLLHLSEAVKEGVKEAGMVGFRFNTVGVSDAVSMGTEGMCYSLQSRDLIADSVETVMGGQWYDANISIPGCDKNMPGVVMAMGRLNRPSIMIYGGTIKPGHFNGQTLDIVSAFQSYGEYVSGSISEDERMDVVRNSCPGFGACGGMYTANTMASAIEALGMSLPYSSSIPAEDPLKIEECKLAGKYILELLKRDLKPRDIITRKSLNNAMVVVMALGGSTNAVLHLIAIARSVGVELTLDDFQDVSDKTPFIADLKPSGKYVMEDLHKIGGVPAVLKYLLEKGLIDGSCMTVTGKTIAENLAECPPLSEGQKIIMPLENPIKKTGHLQILWGNLAPEGSVAKITGKEGLYFSGPARVFEGEEAMLDAITEDPQSLKGTVIVIRGEGPKGGPGMPEMLTPTSAVIGAGLGKEVALLTDGRFSGGSHGFVVGHICPEAQVGGPIGLVRDGDVITIDVEKRKINVDLTAQELADRKLLWRAPPYKASRGTLYKYIKNVKSASEGCVTDE

SEQ ID NO: 415 - DNA, 1800 bp, Chaetomium globosum
atgctctctccgtctctgctgcgcactggcgctcccagggccctggccatgagccgggtcttgccttttaggaaccagtaccgtctcctatccacaacaccccgccggtatgccgacgagaagctcaaccggatttcctccaagatcacacaaccgaagtcgcagggtgcctcccaggctatgctctacggtaccggcttgaccgaggcagacatgtccaaggcccaggtcggcatctcgtccgtctggtacgagggcaacccctgcaacatgcacctgatggagctctctggccatgtccgcaacagcatcgaaaaggccgggctcgtccctatgcgcttcaacaccatcggtgtttctgacggcatcagcatgggcaccacgggcatgcgctacagcttgcagagcagagagatcatcgccgacagcatcgagacggtcatgcagggccagtggtacgacgccaacgtgtcgctgcccggctgcgacaagaacatgcctggtgtcctgatcgccatgggccgcgtcaacaggcctagcattatggtctacggtggcaccatcaagccgggctgcaccatgaagggcgagcccatcgacatcgtcagcgccttccaggcgtacggccagtacatctcgggcgagatcgacgagaagcagcgcttcgacatcatccgcaacgcctgccctggcggcggcgcctgcggtggcatgtacacggccaacaccatggcctcggcgatcgagaccctcggcatgaccctccctggcagcagcagcttcccggccgaggacgcgcgcaagaaggccgagtgcgagagcgtgggcgaggccatcaagaacctcctccgcgagaacatccggcctagcgacatcctgacccgacaggcgtttgagaacgccatggtcgtcgtcggcgtgctgggcggcagcaccaacgctgtgctgcacctcatcgccatcgccgactcggtcggcatcaagctcactatcgacgacttccaagccgtctcggaccgtatccctttactcgccgatctgaagccctcaggcaagtacgttatggaggacctgttcaagatcggcggcaccccggcgctgctcaagttcctcctcaaggagggcctcctcgacggctcgggcattaccgtgactggtaagaccatgaaggagaacgtcgccgacctgcccggcttccccgcggaccagcccatcatccgccccctaaacaacccgctcaagccgacgggccacatccagatcctgcgcggctcgctcgcccccggcgggtcggtgggcaagatcacgggcaaggagggcctccggttcgagggcacggccaaggtgtacgactacgaggatgccttcatcgaggcgctggagcggggcgagatcaagaagggcgagaagacggtggtggtgatccggtacgagggccccaagggcgggcccggcatgcccgagatgctcaagcccagctcggccatcatgggcgccgggctcggccaggacgtcgccctcatcaccgacggccgcttctccggcggcagccacggcttcctcatcggccacatcgtgcccgaggccatggaaggcgggcccatcggcctagtccgcgacggcgacaagattgtcatcgacgccgacaagcgcgtcctcgacctcgaggtgcccgccgacgaaatggcgcgccgcaaggccgagtggaaggcccccgagcccagggccaagcgcggtaccctgaagaaatacgcctcgctggtcagcgatgccagccaggggtgtgtcaccgacaaatag

SEQ ID NO: 416 - protein, 599 aa, Chaetomium globosum
MLSPSLLRTGAPRALAMSRVLPFRNQYRLLSTTPRRYADEKLNRISSKITQPKSQGASQAMLYGTGLTEADMSKAQVGISSVWYEGNPCNMHLMELSGHVRNSIEKAGLVPMRFNTIGVSDGISMGTTGMRYSLQSREIIADSIETVMQGQWYDANVSLPGCDKNMPGVLIAMGRVNRPSIMVYGGTIKPGCTMKGEPIDIVSAFQAYGQYISGEIDEKQRFDIIRNACPGGGACGGMYTANTMASAIETLGMTLPGSSSFPAEDARKKAECESVGEAIKNLLRENIRPSDILTRQAFENAMVVVGVLGGSTNAVLHLIAIADSVGIKLTIDDFQAVSDRIPLLADLKPSGKYVMEDLFKIGGTPALLKFLLKEGLLDGSGITVTGKTMKENVADLPGFPADQPIIRPLNNPLKPTGHIQILRGSLAPGGSVGKITGKEGLRFEGTAKVYDYEDAFIEALERGEIKKGEKTVVVIRYEGPKGGPGMPEMLKPSSAIMGAGLGQDVALITDGRFSGGSHGFLIGHIVPEAMEGGPIGLVRDGDKIVIDADKRVLDLEVPADEMARRKAEWKAPEPRAKRGTLKKYASLVSDASQGCVTDK

SEQ ID NO: 417 - DNA, 1791 bp, Neurospora crassa
atgctcgctccctcccttctgcgggctcaggcccccagagctctggcttctgcccgtctctccctccgctccctctccaccactccccgccgctacaatgcccaggagaagcagctcaacaaggtgtcggccaacatcacccagcccaagtctcagggtgcttcccaggccatgctctacgccaccggcctcaacgaggacgacatgaacaaggcccaggtcggtatctcgtctgtctggtatgagggcaacccttgcaacatgcaccttctcgacctctccggcctcgtcaaggagtccgttgccaaggctggcctcgtccccatgcgcttcaacaccatcggtgtctcggacggtatctccatgggtaccaccggtatgcgctacagcttgcagtcccgtgagattattgccgactccatcgagaccgtcatgaacggccagtggtacgacgccaacatctccctccccggttgcgacaagaacatgcccggtgtcctcatcgccatgggccgtgtcaaccgcccctccatcatggtctacggtggtaccatcaagcccggctgcaacatgaagggcgagaacatcgatatcgtttccgccttccaggcatacggccagtacatctccggtgagatcgacgagaagcagcgcttcgatatcatccgcaacgcctgccctggtggtggcgcctgcggtggcatgtacactgccaacaccatggccaccgccatcgagaccctcggcatgacccttcccggttcctcctcctaccccgccgagtctcccgagaagaagaacgagtgcttgagcgtcggtgaggccatcaagaacctcctccgcgaggacatccgccccaccgatatccttactcgccaggccttcgagaacgccatgatcgtcgtcaacattcttggcggttccaccaacgccgtcctccacttgattgccatcgccgactccgttggcatcaagctcaccatcgatgacttccaggccgtctccgaccgcactcctttccttgccgacctcaagccttccggcaagtgggtcatggaggaccttagcaagattggcggcacccccgcccttctcaaattcctcctcaaggagggaatcctcgacggctccggcatcacctcgaccggtaagaccatgaaggagaacgtcgagaagttccccgacttccccaccgaccaggccatcatccgccctctgtcgaaccccatcaaggaaaccggacacattcagatcctccgcggctctctcgctcccggcggttccgtcggcaagatcaccggcaaggagggtctccgtttcgagggtaaggctcgctgcttcgactacgaggacggctttattgaggctctcgagcgtggcgagatcaagaagggcgagaagaccgtcgtcgtcatccgctacgagggtcccaagggcggccctggcatgcccgaaatgctcaagccttcgtccgccattatgggctacggtctcggcaaggacgttgccctcatcactgacggccgcttctccggtggttctcacggcttcctcatcggccacattgtgcctgaggctatggagggtggccccattggtctcgtccgcgatggcgacaccatcgtcatcgacgccgagaagaaggttcttgaccttgaggttcctgaggaggagctcgccaagcgccgcaaggagtggaaggctcctgagcccaaggctaagcgtggtactctcaggaagtacgcccagctcgtcaaggatgctagctctggctgcgtcactgacgcttaa

SEQ ID NO: 418 - protein, 596 aa, Neurospora crassa
MLAPSLLRAQAPRALASARLSLRSLSTTPRRYNAQEKQLNKVSANITQPKSQGASQAMLYATGLNEDDMNKAQVGISSVWYEGNPCNMHLLDLSGLVKESVAKAGLVPMRFNTIGVSDGISMGTTGMRYSLQSREIIADSIETVMNGQWYDANISLPGCDKNMPGVLIAMGRVNRPSIMVYGGTIKPGCNMKGENIDIVSAFQAYGQYISGEIDEKQRFDIIRNACPGGGACGGMYTANTMATAIETLGMTLPGSSSYPAESPEKKNECLSVGEAIKNLLREDIRPTDILTRQAFENAMIVVNILGGSTNAVLHLIAIADSVGIKLTIDDFQAVSDRTPFLADLKPSGKWVMEDLSKIGGTPALLKFLLKEGILDGSGITSTGKTMKENVEKFPDFPTDQAIIRPLSNPIKETGHIQILRGSLAPGGSVGKITGKEGLRFEGKARCFDYEDGFIEALERGEIKKGEKTVVVIRYEGPKGGPGMPEMLKPSSAIMGYGLGKDVALITDGRFSGGSHGFLIGHIVPEAMEGGPIGLVRDGDTIVIDAEKKVLDLEVPEEELAKRRKEWKAPEPKAKRGTLRKYAQLVKDASSGCVTDA

SEQ ID NO: 419 - DNA, 1788 bp, Magnaporthe grisea
atgatgtcctcaaacctgctgcgcgccagggtgcccaaggccctggctgccaccaggagccatgcggccctcttctccacaacctcgcgccgcgctgagcaactgaacaagacttcggccaagatcacacagcccaagtcccagggtgcgtcacaggccatgctgtacgccaccggcttgaccgaggaggacatgaacaagccgcaggtcggcatctcgtcggtctggtacgagggcaacccctgcaacatgcacatcctcaagctgtcggagcggatccgcgactccgtcaaggccgccaacctggtccccatgcgcttcaacaccattggagtctcggacggtatcagcatgggcacgaccggcatgcgctattcgctgcagagccgtgagatcatcgccgacagtatcgagaccgtcatgcagggccagtggtacgatgccaacatctccatcccgggctgcgacaagaacatgcccggtgttctcatcgccctcggccgtgtcaaccgccccagtttgatcgtttacggcggtaccatcaagcccggctgcagccaaaagggcgagcccatcgacatcgtcagcgccttccaggcctacggccagtacctgactggtgagatcaccgaggagcagcggttcgacatcatccggaacgcgtgccccggcggtggtgcatgcggtggcatgtacactgccaacactttggcgtcggctatcgagactctgggcatgagcttgccgggaagcagcagcaaccccgcagagcaccccagcaagctggccgaatgtgaccaggttggcgaggccatcaagaacatcctccgtgaggacgtgcgcccccgcgacatcatgacgaggcaggcctttgagaacgccatggttgtagtcagcatccttggtggaagcaccaacgccgtcctgcacctgcttgccgttgccgatgcggtcggtgtcaagcttaccattgacgacttccaagccgtttccgaccggacaccgctcctggcagacctcaagccttcgggcaaatacgtcatggaggatgtacacaagattggtggcacgccatctctcctgcgcttcctggccaaggagggcttgatcgatgcttctggcatcaccgtcactggcaagaccatgaaggagaacttggacaagtaccccgacttcccggccgaccagcccatcatccggcctctcagcaaccccctcaagtccacgggccacatccagatcctccgcggtagtctcgcacccggtggctctgtcggcaagattaccggcaaggagggtcttcagttcactggcaaggcccgctgctacgactgcgaggacgactttatcgagtcgctcgagcgtggcgagatcaagaagggtgagaagacggttgtcatcatccgttacgagggccccaagggtggtcccggcatgcccgagatgctgaagcccagctcggccatcatgggtgccggtctcggcaaggacgttgccctcatcactgacggtcgcttctctggcggttcgcacggattcctcatcggacacgttgtgcccgaggccatggagggcggacctatcgcacttgttcgcgatggcgacaccattactattgatgcggagaagcgggtgatcgacacggacgtgtcggacaagaccatggcggagcgccgcgccgagtggaaggctcccccgatcagggagaccaggggaacgctggccaagtacgcagcgctggttagcgacgcgagcagtggttgcgtgacggacaaggtcgcgcgataa

SEQ ID NO: 420 - protein, 595 aa, Magnaporthe grisea
MMSSNLLRARVPKALAATRSHAALFSTTSRRAEQLNKTSAKITQPKSQGASQAMLYATGLTEEDMNKPQVGISSVWYEGNPCNMHILKLSERIRDSVKAANLVPMRFNTIGVSDGISMGTTGMRYSLQSREIIADSIETVMQGQWYDANISIPGCDKNMPGVLIALGRVNRPSLIVYGGTIKPGCSQKGEPIDIVSAFQAYGQYLTGEITEEQRFDIIRNACPGGGACGGMYTANTLASAIETLGMSLPGSSSNPAEHPSKLAECDQVGEAIKNILREDVRPRDIMTRQAFENAMVVVSILGGSTNAVLHLLAVADAVGVKLTIDDFQAVSDRTPLLADLKPSGKYVMEDVHKIGGTPSLLRFLAKEGLIDASGITVTGKTMKENLDKYPDFPADQPIIRPLSNPLKSTGHIQILRGSLAPGGSVGKITGKEGLQFTGKARCYDCEDDFIESLERGEIKKGEKTVVIIRYEGPKGGPGMPEMLKPSSAIMGAGLGKDVALITDGRFSGGSHGFLIGHVVPEAMEGGPIALVRDGDTITIDAEKRVIDTDVSDKTMAERRAEWKAPPIRETRGTLAKYAALVSDASSGCVTDKVAR

SEQ ID NO: 421 - DNA, 1797 bp, Gibberella zeae
atgctttcccggtcactgctgcgctctagagctgtgggagctttccccctctctgccaggaatcatggccgcttcctgtctaccacctccatccgctccgatgacaagctcaacaagatctcctccaacatcactcagcccaaggcccagggtgcttcccaggctatgctctacgccaccggcctctctgaagctgacatgaacaaggctcaagttggcatctcgtccgtctggtacgagggaaacccttgcaacatgcaccttatggacctctctgcccacgtcaaggagtctgtcgccaaggccggtcttattccctaccgattcaacaccatcggtgtctctgatggtatctccatgggtaccactggtatgcgatattccctccagagccgagagattattgccgatagtgttgagactgtcatgaacggtcaatggtatgacgccaacgtcagcttgcccggttgcgacaagaacatgcccggtgttgccattgccatgggtcgtgtcaaccgtcccagcatcatggtttacggtggtaccattaagcccggttgcaccaagcagggcgagtctatcgatatcgtctctgctttccaggcctacggtcaatacatcaccggcgagatcaccgaggagcagcgattcgacattatccgaaatgcctgccctggtggtggtgcttgtggtggcatgtacactgccaacaccatggctactgccattgagactctgggacttaccctccctggtagcagcagcagccctgctgaggaccccagcaagatcgccgagtgtgaggctgttggacctgctatccgcaacattctcaaggaagatatccgacctcgtgacatcatgactcgccaagcctttgagaatgccatgatcgtcactaccatccttggtggcagcaccaacgctgttctgcatcttatcgcaattgccgactctgtcggtatcaagctcgacatcgaggacttccaaaaggtttccgaccgcactcccttccttgccgacctgaagccctctggaaagtgggtcatggccgatatgcacaagattggtggtactcctgctcttctcaagttcctcttgaaggagggtatcattgacggctctggtatcactgtcactggcaagaccatgaagcagaacgtcgaggagttgcctggattccccgaggatcaaaccatcattcgcccccttagcaaccccattaagcctaccggtcacatccagattctccgtggatccctggctcctggtggctgtgttggtaagatcactggcaaggagggtctccgattcgagggtaaggcccgtgtctacgactccgagcccgccttcatctctagccttgaggctggtgagatcaagaagggtgagaagactgtcgttatcatccgatatgatggacccaagggtggccccggtatgcctgagatgctgaagccttcttctgccattatgggtgctggccttggacaggatgtcgcccttctcactgacggtcgcttctctggtggttctcacggtttcattattggtcacattgtccccgaggcaatggagggtggccctatcgcccttgtcgaggacggtgacaccatcgttatcgacgccgagtctcgtgctatcgacctcgttgttcccgaggcagaggttgatcgccgtcgcaaggcctggaaggctcccgctccccgatacaccaagggcacactcagcaagtacgctcgactggtgaccaacgccagtgagggctgtgtcaccgatagcggtctcaagaactaa

SEQ ID NO: 422 - protein, 598 aa, Gibberella zeae
MLSRSLLRSRAVGAFPLSARNHGRFLSTTSIRSDDKLNKISSNITQPKAQGASQAMLYATGLSEADMNKAQVGISSVWYEGNPCNMHLMDLSAHVKESVAKAGLIPYRFNTIGVSDGISMGTTGMRYSLQSREIIADSVETVMNGQWYDANVSLPGCDKNMPGVAIAMGRVNRPSIMVYGGTIKPGCTKQGESIDIVSAFQAYGQYITGEITEEQRFDIIRNACPGGGACGGMYTANTMATAIETLGLTLPGSSSSPAEDPSKIAECEAVGPAIRNILKEDIRPRDIMTRQAFENAMIVTTILGGSTNAVLHLIAIADSVGIKLDIEDFQKVSDRTPFLADLKPSGKWVMADMHKIGGTPALLKFLLKEGIIDGSGITVTGKTMKQNVEELPGFPEDQTIIRPLSNPIKPTGHIQILRGSLAPGGCVGKITGKEGLRFEGKARVYDSEPAFISSLEAGEIKKGEKTVVIIRYDGPKGGPGMPEMLKPSSAIMGAGLGQDVALLTDGRFSGGSHGFIIGHIVPEAMEGGPIALVEDGDTIVIDAESRAIDLVVPEAEVDRRRKAWKAPAPRYTKGTLSKYARLVTNASEGCVTDSGLKN

SEQ ID NO: 423 - DNA, 1797 bp, Aspergillus niger
atgttcgcgtcgagtatccgatcgagagctctgggattgagcccacgagcccggtttgagaatactcgtcttccatcttccactagcgggcgccgttatagatccgatgagcccctcaaccgaatttcctcgaaaatcacacaacccaaatcccagggtgcttcgcaagcaatgctctacgccaccggcctaacagaggaagacatgtccaagccacaggtcggtatctcctcggtgtggttcgagggtaacccatgcaacatgcacttgcatgacctgtctgccattgtgcgcgattccgtgctccgtgcgggtctggtccctatgcgattcaactcagttggagtgtcggatgggatcagtatgggtacaaagggaatgagatacagcctgcagagccgggagctgatcgctgatggtattgagacggtgatgaatgcccagtggtacgatgcgaatgtgtcgctcccgggttgtgataagaatatgccaggtgtattaatagcgatgggacgcacgaaccgacctagcatcatggtctacggtggcagtatcaagcctggatgcagtgcaaagggccagaaattggacctggtcagtgcattccagtcatatggccagttcatcaccggccagatcgacgagaaggagcggttcgatatcattcgcaatgcatgccccggcagaggtgcatgcggtggcatgtacacggctaatacgctggccacggctattgagactatgggaatgactattcctggtagtagtagttgcccggcagatgatcgcaagaagctagttgagtgcgaaaatattggcgaggtggttaaaaatatgctcagggaagatatcaaacccagggatatcttaacacgtcaagccttcgagaatgcaatgattgtagtgaacgtgctgggtggcagtactaatgctgttttacatctgattgccattgctgactctgtcggtatcaagttgactattgatgacttccaggcagtatctgataagacaccgttcctggctgatttgaagccatctggaaagtatcttatgaatgatctttataatatcggtggcacaccagccctcctgaaatatctcctgaaggagggcttgatcgatggctcaggagttactgttaccggtaaaacaatgaaggaaaatgtagcctcatggcctgattttcctgctgaccaggatatcatccgccccctcaacaaccctatcaaaccatctggccatctccagattcttcgcggatcgctggccccgggcggttccgtgggtaagattactggaaaggagggtctgcggtttgagggtatagctaaatgctatgattacgaagatgcattcattgagtcccttgagcggggtgagatcaagaagggcgagaaaacagtcgtgattatccggtatgaaggccccaagggtggcccaggaatgcctgagatgctcaagcccagcgcggccattatgggcgctggacttggccaggacgttgctcttcttacagatggaagattctcgggtggcagtcacggatttttgatcggacatatcgtgccggaagccatggaaggcggcccgatcgcgttggctcgagacggtgatcggatcgtgattgatgctgaggaaagagtggtcgatctggatatctctactgaggagctcgagaagaggaggaaggagtggaacgcacccccgctccggtaccagaagggaactctgaagaaatattgcacgctggtcagcgacgccagccatggttgtgtcacggacggaccgatatag

SEQ ID NO: 424 - protein, 598 aa, Aspergillus niger
MFASSIRSRALGLSPRARFENTRLPSSTSGRRYRSDEPLNRISSKITQPKSQGASQAMLYATGLTEEDMSKPQVGISSVWFEGNPCNMHLHDLSAIVRDSVLRAGLVPMRFNSVGVSDGISMGTKGMRYSLQSRELIADGIETVMNAQWYDANVSLPGCDKNMPGVLIAMGRTNRPSIMVYGGSIKPGCSAKGQKLDLVSAFQSYGQFITGQIDEKERFDIIRNACPGRGACGGMYTANTLATAIETMGMTIPGSSSCPADDRKKLVECENIGEVVKNMLREDIKPRDILTRQAFENAMIVVNVLGGSTNAVLHLIAIADSVGIKLTIDDFQAVSDKTPFLADLKPSGKYLMNDLYNIGGTPALLKYLLKEGLIDGSGVTVTGKTMKENVASWPDFPADQDIIRPLNNPIKPSGHLQILRGSLAPGGSVGKITGKEGLRFEGIAKCYDYEDAFIESLERGEIKKGEKTVVIIRYEGPKGGPGMPEMLKPSAAIMGAGLGQDVALLTDGRFSGGSHGFLIGHIVPEAMEGGPIALARDGDRIVIDAEERVVDLDISTEELEKRRKEWNAPPLRYQKGTLKKYCTLVSDASHGCVTDGPI

SEQ ID NO: 425 - DNA, 1875 bp, Neosartorya fischeri
atgttcgcgtcgagtatccgatcgagagctctgggattgagcccacgagcccggtttgagaatacgtacgagaggaccttccctcgcattgcttctctctccctcctcaaaaatcggcaaatactaataactatcgttactagtcgtcttccatcttccactaccgagcgccgttataaatccgacgagaccctcaaccgaatctcctcgaaaatcacacaacccaaatcccagggtgcctcacaagcaatgctctacgccaccggcctgacagaggaagacatgtccaagccgcaggtcggtatctcctcggtgtggttcgagggtaacccatgtaacatgcacttgcatgacctgtctgcgattgtgcgtgattccgtgcttcgggcgggtctggttcctatgcgattcaactcggttggagtgtcggatgggatcagtatgggcacaaagggaatgagatacagcctacagagtcgggagctgatcgctgatggcattgagacagtgatgaatgcccagtggtatgatgcgaatgtgtcgctcccaggttgcgataagaatatgccaggtgtgttaatggcaatgggacgcacgaatcggcctagtatcatggtctatggcggcagtatcaaacccggatgcagtgcaaagggccaaaagttagacctggtcagtgcattccagtcatatggacagttcatcaccggccagatcgatgagaaggaacggtttgatataattcgcaatgcatgccccggcagaggtgcctgcggtggcatgtacacagctaatacgctggccacagccattgagactatgggtatgaccgttcccggtagcagtagttgcccggcagacgatcctaagaagcttgttgagtgcgaaaacatcggggaggtggttaagactatgctcagggaagatatcaagcccagggatgtcttgacacgtcaagcttttgagaatgcaatgattgtggtgaacgtgctgggtggcagcactaatgctgttctacatctgattgctattgctgactctgttggtatcaagttgactattgatgacttccagacagtgtctgacaagacaccattcctagctgatttgaagccatctggaaaataccttatgaatgacctatacaacatcggtggcacaccagccctccttaaatatctcctaaaggagggcttgatcgatggctcaggaattactgtcactggcaaaacaatgaaggagaatgtagcctcatggcctgacttccctgctaaccaggatatcattcgccccctcagcaaccctattaaaccatctggtcatctccagattcttcgcggatcgctggccccgggcggttctgttgggaagattactggaaaggagggtctgcggtttgagggcacagctaagtgctatgactacgaagatgcattcattgagtcccttgagcggggcgagatcaagaagggcgacaaaacagtcgtgattattcggtatgaaggtcccaagggtggcccaggaatgcctgagatgctcaagcccagcgcggccattatgggtgctggtcttggccaggacgttgcacttctcacggacgggagattctcaggtggcagtcacggattcttgatcggacatattgtgccggaagccatggagggtggcccgatcgcgttagcacgagacggtgatcggatcgtgattgatgctgaggaaagagtggttgatctggatatcccgattgaagagctcgagaagaggaggaaggagtggaaagcacccccgctccgataccagaagggaactttgaagaagtattgcacgctggtcagcgatgccagccatggttgtgtcacagacggcccgatctag

SEQ ID NO: 426 - protein, 624 aa, Neosartorya fischeri
MFASSIRSRALGLSPRARFENTYERTFPRIASLSLLKNRQILITIVTSRLPSSTTERRYKSDETLNRISSKITQPKSQGASQAMLYATGLTEEDMSKPQVGISSVWFEGNPCNMHLHDLSAIVRDSVLRAGLVPMRFNSVGVSDGISMGTKGMRYSLQSRELIADGIETVMNAQWYDANVSLPGCDKNMPGVLMAMGRTNRPSIMVYGGSIKPGCSAKGQKLDLVSAFQSYGQFITGQIDEKERFDIIRNACPGRGACGGMYTANTLATAIETMGMTVPGSSSCPADDPKKLVECENIGEVVKTMLREDIKPRDVLTRQAFENAMIVVNVLGGSTNAVLHLIAIADSVGIKLTIDDFQTVSDKTPFLADLKPSGKYLMNDLYNIGGTPALLKYLLKEGLIDGSGITVTGKTMKENVASWPDFPANQDIIRPLSNPIKPSGHLQILRGSLAPGGSVGKITGKEGLRFEGTAKCYDYEDAFIESLERGEIKKGDKTVVIIRYEGPKGGPGMPEMLKPSAAIMGAGLGQDVALLTDGRFSGGSHGFLIGHIVPEAMEGGPIALARDGDRIVIDAEERVVDLDIPIEELEKRRKEWKAPPLRYQKGTLKKYCTLVSDASHGCVTDGPI

SEQ ID NO: 427 - DNA, 1626 bp, Neosartorya fischeri
atgctgtatgcgactggtttggaggaagcggatatgaacaaggcccaggtgggaatctcctcggtgtggtttgagggaaacccttgcaacatgcacctgatggacttgtccttggtggtacgcgactcggtcgccagggccggcctggttccaatgcgttttaactcgattggcgtttccgacggaatcagcatgggcacgagcggtatgcgatacagtctgcagagtcgtgagatcatcgcggacggcattgagacggtcatgaacgggcagtggtatgacgcgaatatctcacttccaggatgcgataagaacatgcccggtgttgttatggccatgggccgggtcaaccgtccgagcattgtgatctatggtggtagtattaagcctggttgcagcgctggtggccagactttggatctggtgagcgcctttcagtcatatggccaatacattactggtcagatagatgaagcacagcgctttgacatcattcgccatgcgtgcccgggaagtggtgcgtgtggtggcatgtatacagcgaataccatggccacagctattgaagttctcgggctcacggttccaggcagtagtagctgccccgcagaagatccgcgcaagaaagctgaatgtgaagagattggagaaacagtcaagaacctcttgaaggaagatatccggccttcggatattttgacccgccaagcatttgagaacgcaatgatcgtggtcaatattttgggaggtagcaccaatgcagtcatgcatttgattgccattgcccaatctgtgggaattaagctcaccattgatgatttccaagctgtgtctgacaagacgccatttctggccgacctaaaaccatcaggaaagtatgtcatgcatgacctgtacaagatcggcggcacaccggccctactccggttcctgctcaaggagggcttgattgacgggtctggtattactgtgaccggcaaaacaatgaaggagaatgttgcatcttggcctgatttccctgaagatcagcccattatccggccactgagcgatcccatcaagcccacgggtcaccttcaaattctgcgaggatccttggcacctggaggctccgttggtaagatcaccggtaaagagggtctccgatttgaaggcagtgccaagtgctacgactatgaagatgcctttgtggatgctcttgaaaagggagaaattaagaagggtgaaaagacagttgttattatccgatacgaggggccaaagggtggtccaggtatgccggaaatgctcaagcctagtgccgccatcatgggtgccggactgggtcaggatgtcgccctccttaccgacggtcgattttctggtggcagtcatggattcctaatcggtcatattgttcctgaggcaatggatggtggtccaatcgccctggtcaaagatggggacagggtgattatcgacgcagagaagagggtggttgatctggatatatccggagaagagatgcagaggaggaagaaggcatggaaagcgcctgaacctcgggcaaagaaaggcactctaaagaagtatgcagctcttgtcagtgacgctagccatggctgtgtcactgatgggccactttga

SEQ ID NO: 428 - protein, 541 aa, Neosartorya fischeri
MLYATGLEEADMNKAQVGISSVWFEGNPCNMHLMDLSLVVRDSVARAGLVPMRFNSIGVSDGISMGTSGMRYSLQSREIIADGIETVMNGQWYDANISLPGCDKNMPGVVMAMGRVNRPSIVIYGGSIKPGCSAGGQTLDLVSAFQSYGQYITGQIDEAQRFDIIRHACPGSGACGGMYTANTMATAIEVLGLTVPGSSSCPAEDPRKKAECEEIGETVKNLLKEDIRPSDILTRQAFENAMIVVNILGGSTNAVMHLIAIAQSVGIKLTIDDFQAVSDKTPFLADLKPSGKYVMHDLYKIGGTPALLRFLLKEGLIDGSGITVTGKTMKENVASWPDFPEDQPIIRPLSDPIKPTGHLQILRGSLAPGGSVGKITGKEGLRFEGSAKCYDYEDAFVDALEKGEIKKGEKTVVIIRYEGPKGGPGMPEMLKPSAAIMGAGLGQDVALLTDGRFSGGSHGFLIGHIVPEAMDGGPIALVKDGDRVIIDAEKRVVDLDISGEEMQRRKKAWKAPEPRAKKGTLKKYAALVSDASHGCVTDGPL

SEQ ID NO: 429 - DNA, 1845 bp, Aspergillus niger
atgccttttctgcggtggcctccaggccagaaaatcatgatcacacctaccactcctttccgagctgccagaactctggcattcggtggacggatactatcgcccaaaaagtcatcctctcgtcttctctcctcaactgcacatagttatgccgacgaaacactgaacaaagtctcctctaagatcacacaacccaagtcccagggtgcatctcaagcgatgctttacgcgaccggcttgacggagaaagacatgtccaaggcacaggttggaatttcatcagtgtggttcgaagggaatccttgtaacatgcacttgatggatttgtcgtcgctggttcgcgagtcggtagccaaagctggcctggttcccatgcgtttcaactccatcggcgcctctgatggcattagtatgggcacatctggcatgcgattcagtttacagagccgagagatcattgctgatggaattgaaacggtcatgaatgcccagtggtatgatgctaatatctcgttgcctggctgtgataagaacatgccaggtgtgctgatggctatgggtcgggtcaaccgtccgagtatcatggtgtatggtggtagtatcaagcccggctgcagtgcggggggtaagccacttgacttggtcagcgcctttcaatcgtatggccaatatctcactggtgagatcgacgagaaggaacgatttgatattatccgacacgcttgcccaggtgctggtgcctgtgggggtatgtatacggctaatacactggcaacggccatcgagaccctcggaatgacggtccctggaagcagcagtacaccggcagaggatccgaggaagctggcagagtgtgaggacatcggtcagacggtgaagaatctgctgaaggaggacatccgtcccaaggatatcatgacacggcaggcatttgaaaatgctatgattgttgtgaatattcttggaggcagcaccaatgcagtgctgcacttgattgctatcgctaattccgttgggatcaaattgactatcgatgacttccaggctgtgtcagacaagacacctttcttagctgatctaaagccttccggcaagtatgtcatgcatgacctgtacaaagtcgggggcacgcctgcactgctgaagttcctgctcagggaaggccttattgacggctccggcgtcactgttactggcaaaaccatgaaagagaatgtagcctcatggcccgaattttcacctgagcagcccatcatccgccctctaagcaatcccatcaagccaaccggccacttgcagatccttcgtgggtcattggcccccggcggctcggttggaaaaatcaccggcaaagaaggtctacggttcgaaggtcttgctaaatgttacgactttgaggacgctttcattgaggctctcgaacgaggcgagatcaagaagggcgagaaaacggtcgttattattcgatatgaagggcccaaaggcggccccgggatgcctgagatgctcaagcccagctcagctatcatgggcgcgggattgggtcaggatgttgcgctactcactgatggaagattctctggaggtagtcatggctttttaattgggcatgttgtgcctgaggctatggagggtgggcccattgccctggtgaaggatggcgatcggatcgtaattgatgcggagcaaagagtggttgacctgctgatcaccccagaagaaatggcaaagagaagagtgtcttggacagcaccggcacctcgggcgaagaaggggacattaagcaagtatgcgaagctggtgagcgatgcgagccatgggtgcgtgacggatggtccaatatag

SEQ ID NO: 430 - protein, 613 aa, Aspergillus niger
MPFLRWPPGQKIMITPTTPFRAARTLAFGGRILSPKKSSSRLLSSTAHSYADETLNKVSSKITQPKSQGASQAMLYATGLTEKDMSKAQVGISSVWFEGNPCNMHLMDLSSLVRESVAKAGLVPMRFNSIGASDGISMGTSGMRFSLQSREIIADGIETVMNAQWYDANISLPGCDKNMPGVLMAMGRVNRPSIMVYGGSIKPGCSAGGKPLDLVSAFQSYGQYLTGEIDEKERFDIIRHACPGAGACGGMYTANTLATAIETLGMTVPGSSSTPAEDPRKLAECEDIGQTVKNLLKEDIRPKDIMTRQAFENAMIVVNILGGSTNAVLHLIAIANSVGIKLTIDDFQAVSDKTPFLADLKPSGKYVMHDLYKVGGTPALLKFLLREGLIDGSGVTVTGKTMKENVASWPEFSPEQPIIRPLSNPIKPTGHLQILRGSLAPGGSVGKITGKEGLRFEGLAKCYDFEDAFIEALERGEIKKGEKTVVIIRYEGPKGGPGMPEMLKPSSAIMGAGLGQDVALLTDGRFSGGSHGFLIGHVVPEAMEGGPIALVKDGDRIVIDAEQRVVDLLITPEEMAKRRVSWTAPAPRAKKGTLSKYAKLVSDASHGCVTDGP

SEQ ID NO: 431 - DNA, 1848 bp, Aspergillus niger
atgcttctttcccaaacccgggggcgtatgccctccgctctccggagcatcgccaagcgctctttgctgaacagtcgccctctgtctaccactctgcccaagcaacagaacggcaacgatgacgagtatactggtctcaacaaggtctcccgccacattacccagcccatctcccagggtgcttcccaggccatgctgtatgccgcaggcctcactgaggcggacatgaacaaggctcaggtcggcatttcttctgtctggtacaatggcaacccctgcaacatgcatctgctcgatcttaacaaccgtgtccgcgagggtgtccagaaggccggtttggtcggtttccagttcaacaccgtcggtgttagcgatgctatcagtatgggtaccaagggaatgcgattctctctccagagtcgtgatctgattgccgactctatcgagaccgttatgggtggtcaatggtatgacgctaacatcagcattcccggctgtgacaagaacatgcctggtgtgttgatggcaatgggacgagtgaaccgccccagtttgatggtctacggtggaaccatcaagcctggttgcgcctccatgcagggcaacgccgacattgatatcgtctccgccttccaggcctatggtcagttcatcagtaaggaaatcaccgagccccagagatttgacattatccgcaacgcctgccctggaggtggtgcttgcggtggtatgtacactgccaataccatggccactgctatcgaagtcatgggcatgacccttcctggatcctcttccaaccccgccgagtctgacgctaagtaccttgaatgtcttgcggctggtgaggccatcaagaccctgctcaaggaggacattcgtccttcggacatcctgactcgccaagctttcgagaacgccatggtcttggtcaacatcactggtggctccaccaacgccgttcttcacttgattgccattgcggactctgttggtatcaagctcgacattgaagacttccagtccgtctcggatcgcattcctttcctggcggaccttaagccttccggcaagtacgtcatggctgaccttcacaagatcggtggtaccccctccctgctcaagttcttgctgaaggaaggtctcatcgatggctctggcatgactgtcactggtcagaccctggccaagaacttggagaatgtgccggacttccctgaggatcagaagatcatccgtcccctgtccaaccccatcaaggagactggccacatccagatcttgaggggttctctggccccgggtggcagtgtcggcaagatcactggtaaggaaggaaccgtcttcactggaaaggctcgcgtctttgacgacgaggatgatttcattgctgctctcgagcgcaacgagatcaagaaggaggagaagactgttgttgtcatccgctacactggtcctaagggaggacctggcatgcccgaaatgctgaagccctcttccgccctgatgggtgccggtctcggacagtcctgcgctctgatcaccgatggccgtttctctggtggttctcacggtttcttgatcggacacattgttcccgaagccgccgtcggtggccccattggcttggttaaggatggtgatgtcatcaccattgacgccgagaagcgtgttctggaccttgatgttgaggagaccgagctcgcgcaaagaagaaagcagtgggaagccgacagggctgctggcaagctccctcccaccggcctgaccctgagaggtactctcggcaagtacgctagaaccgtcaaggatgccagccacggctgtatcaccgactctctcgaataa

SEQ ID NO: 432 - protein, 615 aa, Aspergillus niger
MLLSQTRGRMPSALRSIAKRSLLNSRPLSTTLPKQQNGNDDEYTGLNKVSRHITQPISQGASQAMLYAAGLTEADMNKAQVGISSVWYNGNPCNMHLLDLNNRVREGVQKAGLVGFQFNTVGVSDAISMGTKGMRFSLQSRDLIADSIETVMGGQWYDANISIPGCDKNMPGVLMAMGRVNRPSLMVYGGTIKPGCASMQGNADIDIVSAFQAYGQFISKEITEPQRFDIIRNACPGGGACGGMYTANTMATAIEVMGMTLPGSSSNPAESDAKYLECLAAGEAIKTLLKEDIRPSDILTRQAFENAMVLVNITGGSTNAVLHLIAIADSVGIKLDIEDFQSVSDRIPFLADLKPSGKYVMADLHKIGGTPSLLKFLLKEGLIDGSGMTVTGQTLAKNLENVPDFPEDQKIIRPLSNPIKETGHIQILRGSLAPGGSVGKITGKEGTVFTGKARVFDDEDDFIAALERNEIKKEEKTVVVIRYTGPKGGPGMPEMLKPSSALMGAGLGQSCALITDGRFSGGSHGFLIGHIVPEAAVGGPIGLVKDGDVITIDAEKRVLDLDVEETELAQRRKQWEADRAAGKLPPTGLTLRGTLGKYARTVKDASHGCITDSLE

SEQ ID NO: 433 - DNA, 1833 bp, Aspergillus terreus
atgcttctctctcagacccggggccgtctgccctccctgcggaccctcaagcggtccatggcggtccgtccgctctctaccaccctccccaagcacaaggccgatgagaaagagcctgtcctcaacaaagtctcccgccatgtcacccaacccatctcccagggtgcgtcccaggccatgctctacgccaccggtctcaccgaggccgacatgaacaaggcccaggtcggtatctcctccgtctggtacaatggcaacccctgcaacatgcacctcctcgacctcaacaaccgtgtgcgggagggtgtccagaaggctggcctggtcgggttccagttcaacaccgtcggagtcagcgacgcgatcagcatgggtacctccggtatgcgcttctcgctgcagagccgtgatctcattgccgactccattgagactgtcatgggtggtcagtggtacgacgccaacatcagtatccctggttgcgacaagaacatgcccggtgtcctgatggccatgggcagagtcaaccgtcccagtctgatggtttacggtggttccattaagcccggctgcgcttcgatgcagaacaacgccgatatcgatatcgtctccgccttccaggcgtacggtcagttcatcagcggagagatcaccgagccccagcgtttcgacatcatccgcaacgcctgccccggaggtggcgcgtgcggtggtatgtacaccgccaacaccatggccaccgccatcgaggtcatgggtatgacccttcctggttcctcctccaaccccgccgagtcggcggccaagaacatcgagtgtctggcggccggtgaggccatcaagaagcttctggtggaagacatccgtccctccgatatcctgactcgccaggccttcgagaatgccatgattgttgtgaacattaccggtggttcgaccaatgcggtgctgcaccttatcgccattgccgattcggtcggcatcaagctagatattgaggacttccagaaggtctcggaccgtgtgccgttcctggctgacctcaagccttccggcaagtacgtcatggcggacctgcacaagatcggtggtactccttctctgctcaagttcctgcttaaggagggcctgatcgatggctctggtatgaccgtcaccggtcagaccctggccaagaacctggagaacgtgccggacttccccgaggaccagaagatcatccgtcctctgtctaaccccatcaaggagaccggtcacatccagattctccgtggctctctggcccctggcggtagtgtcggtaagatcactggtaaggagggtaccgttttcaccggtaaggctcgcgtcttcgaccacgaggacgacttcatcgctgcgctcgagcgcaaggagatcaagaaggaggagaagacggtcgttgtcatccgttatactggacccaagggtggtccgggtatgcctgaaatgctgaagccttcttctgccctcatgggcgccggtctgggcggctcctgcgctctgatcaccgacggacgtttctccggcggctctcacggattcctgatcggacatatcgtccccgaggctgctgtcggtggaccgattggtctggttaaggacggcgatgtgatcaccatcgacgccgtcaagcgtgtgctggatctggacgttgacgagaccactctggccgagagaagaaagcagtgggaggccgacaaggaggctggccgtctccctcctaccggtctgactctgcgtggtaccctgggcaagtatgctagaaatgtcaaggatgccagccacggctgcatcaccgatgctcttgactaa

SEQ ID NO: 434 - protein, 610 aa, Aspergillus terreus
MLLSQTRGRLPSLRTLKRSMAVRPLSTTLPKHKADEKEPVLNKVSRHVTQPISQGASQAMLYATGLTEADMNKAQVGISSVWYNGNPCNMHLLDLNNRVREGVQKAGLVGFQFNTVGVSDAISMGTSGMRFSLQSRDLIADSIETVMGGQWYDANISIPGCDKNMPGVLMAMGRVNRPSLMVYGGSIKPGCASMQNNADIDIVSAFQAYGQFISGEITEPQRFDIIRNACPGGGACGGMYTANTMATAIEVMGMTLPGSSSNPAESAAKNIECLAAGEAIKKLLVEDIRPSDILTRQAFENAMIVVNITGGSTNAVLHLIAIADSVGIKLDIEDFQKVSDRVPFLADLKPSGKYVMADLHKIGGTPSLLKFLLKEGLIDGSGMTVTGQTLAKNLENVPDFPEDQKIIRPLSNPIKETGHIQILRGSLAPGGSVGKITGKEGTVFTGKARVFDHEDDFIAALERKEIKKEEKTVVVIRYTGPKGGPGMPEMLKPSSALMGAGLGGSCALITDGRFSGGSHGFLIGHIVPEAAVGGPIGLVKDGDVITIDAVKRVLDLDVDETTLAERRKQWEADKEAGRLPPTGLTLRGTLGKYARNVKDASHGCITDALD

SEQ ID NO: 435 - DNA, 1824 bp, Aspergillus clavatus
atgcttctctctcagacccggggccgtgtgccctctgttctccggagcttctcccgccgctccctctctaccaccatccccagatacaccgccgataaggatgactctgctctcaacaaggtgtcccgcaatgtcacacagcccatctcgcagggtgcctcccaggccatgctgtacgccacgggtcttaccgaggcggacatgaacaaggctcaggtcggtatctcgtcggtctggtacaatggcaacccctgcaacatgcatctgctcgatctcagcaaccgcgttcgcgaaggagtccagaaggctggtctggttggcttccagttcaacacggtcggtgtcagtgatgccatcagcatgggcaccaagggcatgcgcttctccctgcagagccgtgacctgattgccgactccatcgagaccgtcatgggtggtcagtggtacgacgccaacatcagtatccccggttgcgacaagaacatgcccggtgtgctcatggccatgggccgtgtcaaccgccccagtttgatggtgtatggtggtaccatcaagcccggctgcgccaaaacccagaacaacgccgacatcgacattgtctcggccttccaggcgtacggacagttcctgactggcgagatcaccgagccccagcgcttcgacatcatccgtaacgcctgccccggcggtggtgcttgcggtggtatgtacactgccaacaccatggccaccgccatcgaggtcatgggtatgaccctgcctggctcgtcgtccaaccccgctgagtctaaggccaaggaccttgagtgcttggctgctggtgaggccatcaagcgcctgctgaaggaggatatccgtccctcagacatcctgacccgccaggccttcgagaacgccatgattgtggtcaacatcaccggtggctccaccaacgccgtacttcacttgatcgccattgccgactccgtcggcatcaagctggacatcgaggagttccagaaggtctcggaccgcacccccttcctggcggacctcaagccctccggcaagtacgtcatggccgatctgtacgacatcggcggaactcctgctctgctcaagttcctgctcaaggagggcgtcatcgacggctccggcatgaccgtcaccggtgagaccctggccaagaacttggagaaggtgcccggcttccccgaggaccagaagatcatccgtcctttttcgaaccccatcaagaagactggccacattcagatcctgcgcggctccctggcccccggcggcagtgttggcaagatcaccggtaaggagggtacccgcttcgttggcaaggcccgcgtcttcgaccacgaggacgacttcattgccgctctcgagcgcaacgaaatcaagaaggaggacaagaccgttgtcgtcatccgctacaccggccctaagggtgggcccggcatgcctgaaatgctcaagccctcctccgccctgatgggcgccggcctcggctcctcctgcgcactcatcaccgacggtcgtttctccggcggctcccacggcttcctgattggccacatcgtccccgaggccgccgtcggcggccccatcggcctcgtccaggacggcgacatcatcaccatcgacgccgagaagcgcatcctcgacctcgacgtccccgagcccgagctcgcccagcgcagaaaggattgggaggccgccaaggccgccggcaagttgccccagaccggtctcaccatgagaggtaccctgggcaaatatgccagaaccgtcaaggatgccagccacggctgcattactgattatatagaataa

SEQ ID NO: 436 - protein, 607 aa, Aspergillus clavatus
MLLSQTRGRVPSVLRSFSRRSLSTTIPRYTADKDDSALNKVSRNVTQPISQGASQAMLYATGLTEADMNKAQVGISSVWYNGNPCNMHLLDLSNRVREGVQKAGLVGFQFNTVGVSDAISMGTKGMRFSLQSRDLIADSIETVMGGQWYDANISIPGCDKNMPGVLMAMGRVNRPSLMVYGGTIKPGCAKTQNNADIDIVSAFQAYGQFLTGEITEPQRFDIIRNACPGGGACGGMYTANTMATAIEVMGMTLPGSSSNPAESKAKDLECLAAGEAIKRLLKEDIRPSDILTRQAFENAMIVVNITGGSTNAVLHLIAIADSVGIKLDIEEFQKVSDRTPFLADLKPSGKYVMADLYDIGGTPALLKFLLKEGVIDGSGMTVTGETLAKNLEKVPGFPEDQKIIRPFSNPIKKTGHIQILRGSLAPGGSVGKITGKEGTRFVGKARVFDHEDDFIAALERNEIKKEDKTVVVIRYTGPKGGPGMPEMLKPSSALMGAGLGSSCALITDGRFSGGSHGFLIGHIVPEAAVGGPIGLVQDGDIITIDAEKRILDLDVPEPELAQRRKDWEAAKAAGKLPQTGLTMRGTLGKYARTVKDASHGCITDYIE

SEQ ID NO: 437 - DNA, 1842 bp, Aspergillus nidulans
atgcttctttcacagactcggggccgcctgccctctgctctccgcagcttggccaacagagctgctattcgtccaatctctactacactcccccgccaaaaagcgtcgccaaaagatgatgagcccgtcctcaacaaggtctcccgccatatcacacagccggtgtcccagggtgcttcccaggcgatgctgtacgctacgggtcttactgaggccgacatgaacaaggcccaggttggtatttcctcggtctggtacaacggcaacccttgcaacatgcacctcctcgacctgaacaaccgtgtccgcgagggtgtgcaaaaggctggccttatcgggtaccagttcaacaccattggtgtcagtgatggaatcagtatgggtaccagtggtatgcgttactcgcttcagagccgtgacctcatcgccgactctatcgagaccgtcatgggtggtcagtggtacgacgccaacatcagcatccccggttgcgacaagaacatgcccggtgttttgatggctatgggacgagtcaaccgccccagtttgatggtttacggtggaaccatcaagcccggctgcgcatccatgcagggcaacgctgacatcgatatcgtctctgccttccaagcctacggccagttcatcagcggtgagatcaacgagccccagcgcttcgatatcatccgccacgcctgccccggtggcggcgcttgcggtggaatgtacactgccaacaccatggccacggccatcgaagtcatgggtatgaccctcacgggctcctcgtccaacccggccgaatcgcaagccaaatacgacgaatgtcttcgcgctggtgaagccatcaagcgcctcctcgtcgaagacatccgcccctccgacatcatgactcggcaagccttcgagaacgccatggtcgttgtcaacatcaccggcggctccaccaatgctgtccttcacctcatcgccattgccgactccgtcggcatcaagctcacaattgacgacttccaagccgtctctgaccgcacccccttcctcgcagacctcaagccatccggcaaatacgttatggccgacctccacaacatcggcggcaccccctccctcctcaaattcctcctcaaggaaggcgtcattgatggctccggcatcacagttaccggtgaaactctcgccaagaacctcgagaaagtccccgatttccccgaggaccagaaaatcattcgccccttctccaaccccatcaaggaaacaggccacatccagatcctgcgcggttcgctcgcgccgggcggttgcgttggtaagattaccggtaaggagggaaccgttttcacgggcaaggcccgcgtctttaaccacgaagacgacttcattgccgccctggagcgcaaggaaatcaccaaggatgagcaaactgtcgttgtgattcgctacaccggtcccaagggtggtcccggtatgcctgaaatgctcaagccttcaagcgccctcatgggtgctggcctcggccaaacctgcgccctgatcacagacggacgcttctccggtggttcgcacggcttccttattggacacatcgtcccagaggctgccgtcggtgggccgattggtctcgtacacgacggcgacgtgatcaccattgatgccgagaagcgcgttttggaccttgacgttgacgaggcggaactcgctaagcgacggaagcagtgggaggctgataaggcggcgggcaagttgccccagaccgggttgaacttgcgcgggacgcttggaaagtatgcccggaatgtcaaggatgctagttccgggtgtattacggacgctttcgattaa

SEQ ID NO: 438 - protein, 613 aa, Aspergillus nidulans
MLLSQTRGRLPSALRSLANRAAIRPISTTLPRQKASPKDDEPVLNKVSRHITQPVSQGASQAMLYATGLTEADMNKAQVGISSVWYNGNPCNMHLLDLNNRVREGVQKAGLIGYQFNTIGVSDGISMGTSGMRYSLQSRDLIADSIETVMGGQWYDANISIPGCDKNMPGVLMAMGRVNRPSLMVYGGTIKPGCASMQGNADIDIVSAFQAYGQFISGEINEPQRFDIIRHACPGGGACGGMYTANTMATAIEVMGMTLTGSSSNPAESQAKYDECLRAGEAIKRLLVEDIRPSDIMTRQAFENAMVVVNITGGSTNAVLHLIAIADSVGIKLTIDDFQAVSDRTPFLADLKPSGKYVMADLHNIGGTPSLLKFLLKEGVIDGSGITVTGETLAKNLEKVPDFPEDQKIIRPFSNPIKETGHIQILRGSLAPGGCVGKITGKEGTVFTGKARVFNHEDDFIAALERKEITKDEQTVVVIRYTGPKGGPGMPEMLKPSSALMGAGLGQTCALITDGRFSGGSHGFLIGHIVPEAAVGGPIGLVHDGDVITIDAEKRVLDLDVDEAELAKRRKQWEADKAAGKLPQTGLNLRGTLGKYARNVKDASSGCITDAFD

SEQ ID NO: 439 - DNA, 1848 bp, Aspergillus oryzae
atgcttctttcacaaacccgggggcgtatgccctctgctctgcggagcctctccaggcggtccgccgtcaatgttcgtcccctctctaccaccctccccaagcaaaaggcctcttcctccgaagacgacaacgctctgaacaaggtctcccgccatgtcacacagcccatctcgcagggtgcttcccaggccatgctttacgctaccggtctcaccgaggaggacatgaacaaagctcaagtcggtatctcctccgtttggtatagcggtaacccctgtaacatgcatctgctcgatctcaaccaccgcgtcaagcaaggtgtggaacaggcaggcttgatcggcatgcagttcaacaccgtcggtgtcagtgatgcaatcagtatgggtacgaagggtatgcgatattctcttcagagtcgtgatctgattgccgactctatcgagactgttatgggtggtcagtggtacgatgccaacatcagtatcccgggttgcgacaaaaacatgcccggtgtgttgatggccatgggcagagtcaaccggccgagcattatgttgtacggaggcaccatcaagcccggttgtgccgctacccaaaacaatgccgagattgacatcgtctccgcattccaggcctacgggcagttcctgagcggcgacattaccgagcctcagcgatttgatattatccgtaacgcttgcccaggaggcggtgcctgcggtggtatgtacacggccaacaccatggccaccgccattgagaccattggtatgaccctccctggctcttcttccaaccccgccgagtcccgcgccaaggaccttgagtgtctggctgttggtggggcgatcaagaagcttctgaaggaggacatccgccctagggatattatgacccgccaagctttcgaaaacgccatggttgtggtgaacatcaccggtggctcgaccaacgctgtgctgcacttgattgccatcgctgattcggtcggcatcaagctggatattgaggacttccagtccgtctccgaccgtattcctttcttggctgatctgaagccatcgggcaagtacgtcatggccgacatgcacaagatcggaggtacccccgcactgctcaagttcctgctcaaggaaggcctcatcgatggttccggcatgactgtcaccggtgagactctagccaagaacctcgagaaggttcccgatttccccgaagatcagaagatcatccgccctctgtccaaccccatcaaggagactggccatatccagattctgaagggatccctggctccgggtggcagtgttggtaagatcactggcaaggagggtacttctttcactggtaaggcacgtgtcttcgatgatgaggatgatttcatcgctgctctggagcgtggtgagatcaaaaaggaggacaagactgttgtggttatccgctacaccgggcccaaggggggtcctggtatgcccgaaatgttgaagccctcttctgcccttatgggctatggtctcggacagtcggttgccctcatcaccgatggacgtttctccggcggctctcatggcttcctgatcggacacattgtccctgaggctgctgttggtggacctattggtctcgtcaaggatggtgatgtcatcgtcattgatgctgagaagcgcgttctcgaccttgaggttgaccaggagactctcgccgagagacgcaagcagtgggaagccgataaggaggccggcaagctgcctcccaccggtctgactatgagaggaaccctcggcaagtacgctaggaccgtcaaggatgccagccacggctgtatcaccgatgctcttgattaa

SEQ ID NO: 440 - protein, 615 aa, Aspergillus oryzae
MLLSQTRGRMPSALRSLSRRSAVNVRPLSTTLPKQKASSSEDDNALNKVSRHVTQPISQGASQAMLYATGLTEEDMNKAQVGISSVWYSGNPCNMHLLDLNHRVKQGVEQAGLIGMQFNTVGVSDAISMGTKGMRYSLQSRDLIADSIETVMGGQWYDANISIPGCDKNMPGVLMAMGRVNRPSIMLYGGTIKPGCAATQNNAEIDIVSAFQAYGQFLSGDITEPQRFDIIRNACPGGGACGGMYTANTMATAIETIGMTLPGSSSNPAESRAKDLECLAVGGAIKKLLKEDIRPRDIMTRQAFENAMVVVNITGGSTNAVLHLIAIADSVGIKLDIEDFQSVSDRIPFLADLKPSGKYVMADMHKIGGTPALLKFLLKEGLIDGSGMTVTGETLAKNLEKVPDFPEDQKIIRPLSNPIKETGHIQILKGSLAPGGSVGKITGKEGTSFTGKARVFDDEDDFIAALERGEIKKEDKTVVVIRYTGPKGGPGMPEMLKPSSALMGYGLGQSVALITDGRFSGGSHGFLIGHIVPEAAVGGPIGLVKDGDVIVIDAEKRVLDLEVDQETLAERRKQWEADKEAGKLPPTGLTMRGTLGKYARTVKDASHGCITDALD

SEQ ID NO: 441 - DNA, 1836 bp, Ajellomyces capsulatus
atgctccgattacaagcacggggccggatgcccaactgcttcaaaagactgcttttcccattgtcctgtcgagctctctccgcaactccatacccatattcatcttcgtcctcacaggagaagaagctcaacagtgtttcccaacatgtaacgcaacccatttcccaaggtgcctcacaggccatgctttacgctacgggcctaatgccggaggatatgtcgaaagctcaagttggcatctctagcgtctggtacaacggaaacccctgcaacatgcatctcctcgatctcagcaaccgtgtgcgcgaaggtgtgcaaaaggcgggactcataggttaccagttcaacactgttggcgtcagtgacgctatcagcatgggtacgtcaggtatgcggtacagtttgcagagtcgggatctcatcgcggactcgattgagacggtcatgggtggtcaatggtatgatgctaacatcagcatccccgggtgtgacaagaatatgcctggcgtggttatggcaatgggaagagtaaaccggccaagtttgatggtttatggcggaacaattaagcccgggtgcgcggtaacccaaaacaacgccgatatcgacatcgtgtctgcgttccaggcttacggccaattcataactggtgagatcactgaggctcagcgatacgacatcatccgacatgcttgccctggcggtggtgcttgtggggggatgtacactgcaaacaccatggcgtctgcgatcgaagttatgggaatgacgttaccgggatcttcatcgaaccctgcagaatccaaagccaaggatctagaatgcctgacggctggggaagcaattaaaacccttctcaaggaggatatccgtcccactgacatcttgacgcgccaggcctttgaaaatgcaatggttcttgtcaacatcaccggcggctccaccaacgcagtgctccatctgatcgctatagctgactctgtcggaattaaactcacaattgacgatttccagtcagtcagtgaccgcatccccttcctcgcagatctcaagccttccggtaaatatgttatggccgatcttcatacaattggtggtactccctcattactcaagttcctcttgaaggagggtctcatcgacggctctggaattaccgtgactggtcaaaccctggccaagaacctcgagaaggttcctgaattcccttcagatcagaaaatcattcgacccctcaacaaccccatcaagaaaactgggcacatccagatcctccgcggaagcctcgcccctgaaggcagcgtcggcaaaattacaggaaaggagggtaccaagttcactggcaaggcgaaggtctacgatcatgaagacgattttattaccgcattagaacagaatgagatttcgaaggacgagaagacagtcgtggtaattcgttacactgggcccaagggtggtccgggaatgcctgaaatgctcaagccttcctccgcccttatgggcgcggggctaggttcatccgtcgccttgatcacagacggccgtttcagtggtggctctcatggcttcctgatcggccacatcgttcccgaagccgcagtcgggggccctattgcgctcgtccacgatggcgatgtcatcaccattgacgccgaaaaacgtttgctcgaccttgacgtctccgaacacatcctagctcagcgtaggaaggaatgggccgatagggagagtaaaggactaaatcccgttacgggaatgaaaatgagagggacgctgggaaaatatgctagatctgtcaaggacgcaagtcacggatgcatcaccgacgcattatag

SEQ ID NO: 442 - protein, 611 aa, Ajellomyces capsulatus
MLRLQARGRMPNCFKRLLFPLSCRALSATPYPYSSSSSQEKKLNSVSQHVTQPISQGASQAMLYATGLMPEDMSKAQVGISSVWYNGNPCNMHLLDLSNRVREGVQKAGLIGYQFNTVGVSDAISMGTSGMRYSLQSRDLIADSIETVMGGQWYDANISIPGCDKNMPGVVMAMGRVNRPSLMVYGGTIKPGCAVTQNNADIDIVSAFQAYGQFITGEITEAQRYDIIRHACPGGGACGGMYTANTMASAIEVMGMTLPGSSSNPAESKAKDLECLTAGEAIKTLLKEDIRPTDILTRQAFENAMVLVNITGGSTNAVLHLIAIADSVGIKLTIDDFQSVSDRIPFLADLKPSGKYVMADLHTIGGTPSLLKFLLKEGLIDGSGITVTGQTLAKNLEKVPEFPSDQKIIRPLNNPIKKTGHIQILRGSLAPEGSVGKITGKEGTKFTGKAKVYDHEDDFITALEQNEISKDEKTVVVIRYTGPKGGPGMPEMLKPSSALMGAGLGSSVALITDGRFSGGSHGFLIGHIVPEAAVGGPIALVHDGDVITIDAEKRLLDLDVSEHILAQRRKEWADRESKGLNPVTGMKMRGTLGKYARSVKDASHGCITDAL

SEQ ID NO: 443 - DNA, 1845 bp, Coccidioides immitis
atgcttcagctaaggcctcgcgggcatatgccctacaggcaattgctcacttatctctctcaccgtgccttttcttccagatcgacgttccagcagaagtcttcgtcgaatcccccgtcaaaatcaggaaagccattaaatgaagtatccagccatatcacgcagccaatctcccagggcgcttcccaggctatgctttacgctaccgggctttcgacggacgacatgtccaagcctcaggtcgggatctccagtgtctggtacaatgggaatccctgcaacatgcacctcctggacctaagcaacatcgtgcgggaaggcgtgcaaaaggcaggattgatcggatatcaattcaacaccattggtgttagtgacggaattagcatgggaacaaaaggaatgagatacagcttgcagagcagagacctaatcgccgattccatagagaccgtcatgggtggtcagtggtacgacgcaaatatcagtctgccgggatgcgataaaaacatgccgggagttatcatggctatgggtcgtgtgaaccggccgagtttgatggtatatgggggaacgatcaggccgggctgtgctgcaacacaaaacaatgctgatatcgatatcgtgtccgccttccaggcatacggccaattcttgactggggagatctccgaggagcagcgatttgatattatccgccatgcctgccctggtggtggtgcatgtggtggaatgtacaccgcaaacaccatggcttcggctatcgaggtcatgggaatgacccttccgggctcttcctccaacccagcagaatctaaggcaaagaaggccgaatgtctggctgcgggcgaagccatcaagaaccttctcatcgaggatattcgaccatccgacatcctcaccaggaccgcatttgaaaacgccatgatcttggtgaacatcactggaggctccaccaacgcggtcctccacctcattgccatggccgactccgtcggcatcaaactcaccattgatgacttccaggccgtcagcgatcgtaccccgttcctcgcagaccttaagccatccggaaagtacgtcatggctgatctgcacaacattggcggcaccccatccctgattaaattcctactgaaggagggtgtcctcgacggttcgggaatgactgttaccggtcagaccttggccaagaacgtagagaatgtccctgacttcccatctgaccaaaagatcatccgacctttcagcaacccaatcaagaagaccggccatcttcaaatcctccgtggcagcctcgctcctgaggggagtgtaggcaagatcacaggcaaagaaggaacaagtttcacaggcaaagctagagtgtatgacgatgaagatgattttattgcctctttggaacgaaacgaaattaaaaaggaagagaaaactgtcgttgttatccgatatactggaccgaagggaggaccaggaatgccagagatgcttaagccttcttctgccctgatgggtgccggattgggctcttctgttgccctcatcacggacgggcgtttcagtggtggttctcatggcttcttgatcggacacatcgtccctgaagccgcggttggcggaccaatcgccctcgttgaagacggcgacatcatcaccatcgacgccgagaagcgagttctcgatcttgaagtcggtgaagacgttctcgcgcaaagaaggaagaagtggcaggagaaacaggaggcaggcctcggtcgtccaactggattgacgatgaggggaactctgggtaaatatgccagagctgtgacggatgctagtcatggatgtatcaccgacggtgtatga

SEQ ID NO: 444 - protein, 614 aa, Coccidioides immitis
MLQLRPRGHMPYRQLLTYLSHRAFSSRSTFQQKSSSNPPSKSGKPLNEVSSHITQPISQGASQAMLYATGLSTDDMSKPQVGISSVWYNGNPCNMHLLDLSNIVREGVQKAGLIGYQFNTIGVSDGISMGTKGMRYSLQSRDLIADSIETVMGGQWYDANISLPGCDKNMPGVIMAMGRVNRPSLMVYGGTIRPGCAATQNNADIDIVSAFQAYGQFLTGEISEEQRFDIIRHACPGGGACGGMYTANTMASAIEVMGMTLPGSSSNPAESKAKKAECLAAGEAIKNLLIEDIRPSDILTRTAFENAMILVNITGGSTNAVLHLIAMADSVGIKLTIDDFQAVSDRTPFLADLKPSGKYVMADLHNIGGTPSLIKFLLKEGVLDGSGMTVTGQTLAKNVENVPDFPSDQKIIRPFSNPIKKTGHLQILRGSLAPEGSVGKITGKEGTSFTGKARVYDDEDDFIASLERNEIKKEEKTVVVIRYTGPKGGPGMPEMLKPSSALMGAGLGSSVALITDGRFSGGSHGFLIGHIVPEAAVGGPIALVEDGDIITIDAEKRVLDLEVGEDVLAQRRKKWQEKQEAGLGRPTGLTMRGTLGKYARAVTDASHGCITDGV

SEQ ID NO: 445 - DNA, 1830 bp, Botryotinia fuckeliana
atgctctcacaattgagaacgagggcaaatgcctctcttctcacctcaagaagagcttcacaatatgtgcgctctctatcgtccacatcctctctccgcacatcctccaatgactcagaaccacagctcaacagaacctcagctgctatcacacaaccaaaatcacaaggtgcttcgcaggcaatgttatatgccactggtatgaccgaggaaagattaaacaaagcacaagttggtatctcttcagtatggtggtcgggaaatccttgcaacatgcatcttttggaactcaaccacaaagtaaaggaaggagtagagagagccggtttggtaggatatcaattcaacaccattggagtttcggacggtatttctatgggtacaaagggtatgagatacagtcttcagtcaagagatttgattgcggatagtattgaaactgtgatgggtggtcaatggtatgatgccaacatttcgattcctggatgtgacaagaacatgcctggtgttatgatggcaattggcagagtcaacagaccagcccttatggtttatggtggttctattaaaccagggtgtgccgcaacacaaaacaacgcagatatcgatattgtctccgcattccaagcctacggacaattcattactggagagattacagaagaacaaagattcgatgttattcgtcatgcttgcccaggtcaaggtgcatgtggtggaatgtataccgcaaacaccatggcatcagctatcgaaattatgggaatgactcttcctggatcttctaccaaccccgcagattcaaaggccaaattacttgaatgctacgcagctggtggtgcaatcaaaactcttctcaaggaggacatcagacctagagatatcatgacaagacaggctttcgaaaatgctatggttcttgttaccattactggaggatctaccaacgctgttcttcatcttattgctatggcagatgctgtaggaatcaagctcacaatcgatgatttccaagctgtttctgaccgaacacctttcctcgcagacctcaaaccatctggtaaatacgtcttcaatgatctttacagcatcggtggtactccttctcttatcaaactcctcatcaaggaaggtgtcattgatggatcaggaatgactgttactggtaagacccttgctgagaacgtcaaggatgttcgtgatttcccatccgaccaagaaattattcgcccattctcaaaccccatcaaaaagtctggtcacattcaaattctccgcggttccctcgcaccaggtggatccgttggtaaaatcaccggtaaagaaggattacgattcgttggaaaagctaaggtttatgatgctgaaaatgatttcatcgaagcccttgagcgtggcgaaatcaagaagggagagaagaccgttgtagtcattcgttatgaaggaccaaagggtggaccaggtatgccagaaatgttaaaaccatcctcggcaatcatgggtgcaggacttggaaaggatgtcgctcttattaccgatggacgtttcagtggaggatctcatggattcttgattggacatattgtaccagaggcacaagtcggtggaccaattggattggttagggatggtgatactattgttattgatgctgagacgagagtattggatttggaagttgagggtggtgaggaggaattggagaggaggagaaaagaattcgtcgcacctcctttgaaatataccaagggtactttggcgaaatactcgagattggtacaagatgctagtcatggatgtattaccgatggagaaatcgttgaggcatga

SEQ ID NO: 446 - protein, 609 aa, Botryotinia fuckeliana
MLSQLRTRANASLLTSRRASQYVRSLSSTSSLRTSSNDSEPQLNRTSAAITQPKSQGASQAMLYATGMTEERLNKAQVGISSVWWSGNPCNMHLLELNHKVKEGVERAGLVGYQFNTIGVSDGISMGTKGMRYSLQSRDLIADSIETVMGGQWYDANISIPGCDKNMPGVMMAIGRVNRPALMVYGGSIKPGCAATQNNADIDIVSAFQAYGQFITGEITEEQRFDVIRHACPGQGACGGMYTANTMASAIEIMGMTLPGSSTNPADSKAKLLECYAAGGAIKTLLKEDIRPRDIMTRQAFENAMVLVTITGGSTNAVLHLIAMADAVGIKLTIDDFQAVSDRTPFLADLKPSGKYVFNDLYSIGGTPSLIKLLIKEGVIDGSGMTVTGKTLAENVKDVRDFPSDQEIIRPFSNPIKKSGHIQILRGSLAPGGSVGKITGKEGLRFVGKAKVYDAENDFIEALERGEIKKGEKTVVVIRYEGPKGGPGMPEMLKPSSAIMGAGLGKDVALITDGRFSGGSHGFLIGHIVPEAQVGGPIGLVRDGDTIVIDAETRVLDLEVEGGEEELERRRKEFVAPPLKYTKGTLAKYSRLVQDASHGCITDGEIVEA

SEQ ID NO: 447 - DNA, 1692 bp, Phaeosphaeria nodorum
atgtctctcgcacgctttggaggcgcactttcacgtcccaagtcgcagggcgcctcgcaggccatgctgtacgcgactggcatgagcgaggatgatatgaataaggcccaggtcggcatctcatcagtgtggtactcgggcaacccatgcaatatgcacctgatggacctcaacaacaaggtcaaagagggtgtgcagcgggctggtctcttgggcatgcagttcaacaccattggtgtgagtgacggcatttccatgggcaccaagggcatgcgctactcgctgcagtcgcgtgagatcatcgcagactcgattgagactgtcatgggcggccaatggtacgatgcgaacatttccatccccggatgcgacaagaacatgcccggtgtcatcatggctatgggccgtgtgaaccggccctcgctgatggtctacggcggaaccatccagcctggatgcgcaaagactctcgacaaccagtccatcgacatcgtctctgccttccaggcctacggacaattcataactggagagatcactgaagaccagcgcttcgatgtcatcagacacgcatgcaacggtcagggtgcttgtggaggcatgtacacggcaaacacaatggctactgccattgagaccatgggcatgtcgctgcccggctcatcgtcgaaccccgccaactcgcaggccaagatgctggaatgcctggctgcgggaggcgcaatcaagaacctgctcaaggaggacctgcgccccagcgacatcctcaccaggcaagcactcgagaacgccatggttgtcatcagcatcaccggaggctccaccaacgccgtattacacctgatcgccatcgccgactctgttggtctcaaactgaccatcgacgacttccagagcgtgagcgaccggattccgttgctcgctgatctcaagccctctggcaagtacgtcatggctgatgttcacgacatcgggggtactcccgcactgctcaagttcctgcttaaggagggcctgctcgacggcagccagatgactgtcactggcaagaccctaaagcagaacttggagaacgtcaaggacttcccctccgaccagaagatcatccgccctctcagcgagcccctcaagactaccggccatttgcaaattctccgtggtagtctcgcaccaggtggctgtgtcggcaagatcaccggcaaagaaggaaccatcttcaccggcaaagccaaatgctacgatgccgaagacgacttcatcagtgcgctcgagcgcggcgagatcaaaaagggcgagaagactgtcgtcgtcatccgctacgaaggccccaagggcgggcccggcatgcctgaaatgctcaagcccagctccgccatcatgggcgcaggtctcggcaaggatgtcgcactcatcactgacgggcgcttcagcggtggtagccacggtttcttgatcggccacattgtgcctgaagcgcaggagggcggaccgatcggtcttgtccaggatggcgatgagatcaccatcgactctgagtcgaatgaacttaacattggcgtgagcgagcaggagttggcggagcgcaggaagagctggaaggcgccggcgctgaagtatcaaaagggcacgctgttcaagtatgcgcggttcgtcaaggacgccagctcgggatgcgtgacggactcggcataa

SEQ ID NO: 448 - protein, 563 aa, Phaeosphaeria nodorum
MSLARFGGALSRPKSQGASQAMLYATGMSEDDMNKAQVGISSVWYSGNPCNMHLMDLNNKVKEGVQRAGLLGMQFNTIGVSDGISMGTKGMRYSLQSREIIADSIETVMGGQWYDANISIPGCDKNMPGVIMAMGRVNRPSLMVYGGTIQPGCAKTLDNQSIDIVSAFQAYGQFITGEITEDQRFDVIRHACNGQGACGGMYTANTMATAIETMGMSLPGSSSNPANSQAKMLECLAAGGAIKNLLKEDLRPSDILTRQALENAMVVISITGGSTNAVLHLIAIADSVGLKLTIDDFQSVSDRIPLLADLKPSGKYVMADVHDIGGTPALLKFLLKEGLLDGSQMTVTGKTLKQNLENVKDFPSDQKIIRPLSEPLKTTGHLQILRGSLAPGGCVGKITGKEGTIFTGKAKCYDAEDDFISALERGEIKKGEKTVVVIRYEGPKGGPGMPEMLKPSSAIMGAGLGKDVALITDGRFSGGSHGFLIGHIVPEAQEGGPIGLVQDGDEITIDSESNELNIGVSEQELAERRKSWKAPALKYQKGTLFKYARFVKDASSGCVTDSA

SEQ ID NO: 449 - DNA, 1758 bp, Pichia guilliermondii
atgttatctgctagagtacattctagactattttccacttcggtggtccgttgtgagaaagtgctcaacaagtactcttcgatcgtgacccaggataagtctcaaggtgcttcgcaagccatgttgtatgctacgggctttcaagatgaagatttcgataaggctcaaattggagttggaagtgtatggtggtcaggaaacccttgtaatatgcacttgatggacatgaacgacagatgtacagcttctgtgaacaaggctggattgaaaggaatgcaattcaattccattggagtttctgatggtatcaccaacggtactgatggtatgagatattcattacaatcgagagaaatcattgccgattcatttgagactttagtgatggcccagatgtatgatggtaacattgccattccatcgtgtgacaagaatatgcctggtactcttatggctatgggtagacacaatcgtccatcgattatggtttatggtggtactatcatgcctggatctccttcttgtggtggtgcaaatgttcctgagaagattgatatcattagtgctttccaatcttatggtcaatttttgagtggacagatcaatgaggaacaaagaaaggacattgtaagacatgcttgtccaggtgctggtgcttgtggtggtatgtataccgccaacaccatggcttctgctgctgaggtcatgggtatgtcacttccatactcttcttcagctcctgccatttcgaaagaaaaagctgatgagtgtgacaatgttggttatgccatgaaacatttattagaaattgatttgaaacccaaggatataatgactaaaaagtcctttgagaatgccatcacctacatcattgccactggtggttccacaaatgcggtgttgcacttgattgccattgctcattctgtgggtattgacttgactgttgatgacttccaacgtatttctgataccactccattgttggctgatttcagaccatctggtaaatacgttatggcagatcttcaacaatttggaggtactcctgcggtgatgaaattgttgttggaagaaggtttcctcgatggagaccagtacaccgtcaccggtaataccatcaaagaaaacttatcaaaggtcaagggattgccagccagtcaagacattgttcgtcctgtttctaacccattgaaaccaaatggacacttgcaaattctcaagggtactttagcaccaggaagtgccgttggtaagattactggtaaagaaggtacctactttaagggagctgccagagtgtttgacaatgaagaattgttcatcaaggctcttgaaaagggagagatcaagaagggagaaaagaccgtttgtgtgattcgttatgagggccctaagggtggtcctggtatgcccgaaatgttgaaaccttcttcagcattgatgggttatggtttgggtaaagacgttgcattgttgactgatggtaggttctctggtggttctcatggtttcttgattggtcacatcgtgccagaagccgccgagggtggcccaattgccttggttcacgacggagatgagattgtcattgatgctgaaaacaacaaaattgacttgcttgtctcggaagaaattctcgctgaaagaaagaagctgtggtctcctcctgctccaagatacacgagaggaaccttggccaagtactccaaattggttagtgatgcttccaccggttgtgtaactgacttggactaa

SEQ ID NO: 450 - protein, 585 aa, Pichia guilliermondii
MLSARVHSRLFSTSVVRCEKVLNKYSSIVTQDKSQGASQAMLYATGFQDEDFDKAQIGVGSVWWSGNPCNMHLMDMNDRCTASVNKAGLKGMQFNSIGVSDGITNGTDGMRYSLQSREIIADSFETLVMAQMYDGNIAIPSCDKNMPGTLMAMGRHNRPSIMVYGGTIMPGSPSCGGANVPEKIDIISAFQSYGQFLSGQINEEQRKDIVRHACPGAGACGGMYTANTMASAAEVMGMSLPYSSSAPAISKEKADECDNVGYAMKHLLEIDLKPKDIMTKKSFENAITYIIATGGSTNAVLHLIAIAHSVGIDLTVDDFQRISDTTPLLADFRPSGKYVMADLQQFGGTPAVMKLLLEEGFLDGDQYTVTGNTIKENLSKVKGLPASQDIVRPVSNPLKPNGHLQILKGTLAPGSAVGKITGKEGTYFKGAARVFDNEELFIKALEKGEIKKGEKTVCVIRYEGPKGGPGMPEMLKPSSALMGYGLGKDVALLTDGRFSGGSHGFLIGHIVPEAAEGGPIALVHDGDEIVIDAENNKIDLLVSEEILAERKKLWSPPAPRYTRGTLAKYSKLVSDASTGCVTDLD

SEQ ID NO: 451 - DNA, 1782 bp, Debaryomyces hansenii
atgagtgcattgacaaagtgtaaacgtaacttaggaggtagaaacatccggttattttccaattctgctttgaattgtgacaacaagttaaataagtactcttctattgtgacccagcccaagtcgcaaggggcatcccaagcgatgttgtatgcgaccgggtttgatgaagaagatatgaacaaggcacaggttggtgttggatctgtctggtggtcaggaaatccgtgcaacatgcacttgatggagatgaacaacaaggtgaccgaatctgttaacagagccggtttgaaggggatgcagttcaactcgattggtgtctcggatgggatcactaatggtactgatggtatgagatactcgttgcaatcgcgtgaaattattgctgactcgtttgagaccatgatgatggcccagatgtacgatgccaacatcgcaattccgctgtgtgacaagaacatgccaggtaccttgatggctatgggtagacacaacagaccatctattatggtttacggtggtactattatgccaggttctccaacttgtggtaactcgattattcctgacaagattgatatcatctctgcgttccaatcgtatggtcaattcttatcggaccagatcaatgagggcgaaagaaaggatatcattaagaatgcatgtcctggtgctggtgcatgtggtggtatgtacactgccaacaccatggcctctgctgctgaagttttaggtatgtccttaccattttcgtccagtgccccagccatttcgaaggaaaaggcacatgaatgtgctactgtcggtgatgccatcaagaatttgttagtccttgacttgaagccaatggatatcatgaccaagaaggcttttgaaaatgcaatcacttatattatcgctactggtggttctactaatgccgttttacatttgattgccatggcaaacaccgttggtgttgacttaactgtcgatgatttccaaagaatttcggactccactccattattagccgatttcaagccaagtggtaagtacgttatggctgacttacaaaagtacggtggtaccccagctgtcatgaagttgttattcgaggaaggtttaattgatggatctcaatatactgtcacaggtaagactatcaaagaaaatttggaatctgttaaaggcttgccagctgaacaagaaattgtcagacccttatctaacccattaaagccaagtggccacttacaaattttaaagggtactttagctccaggtagtgctgtcggtaaaattactggtaaggaaggtacttatttcaagggtaaatctagagttttcgatgatgaaatggcattcattactgctttagaaaatggcgaaatcaagaaaggtgaaaagactgtttgtgtcattagatacgaaggtcctcaaggtggccctggtatgccagagatgttgaagccttcttctgcattaatgggttacggtttaggccaagacgttgcgttattaactgatggtagattctctggtggctctcatggtttcttaattggtcatattgttccagaagctgcagttggtggaccaattgcgttagtgcatgatggtgatgaaattgttattgacgctgaaaacaatagaatcgacttattagtatctgaagatattttagccgaaagaaagaaggaatggaccccaccaaagccaagatatacaagaggtacattggctaaatattctaagttagtcagtgatgcttcgttgggttgtgttactgatttggtataa

SEQ ID NO: 452 - protein, 593 aa, Debaryomyces hansenii
MSALTKCKRNLGGRNIRLFSNSALNCDNKLNKYSSIVTQPKSQGASQAMLYATGFDEEDMNKAQVGVGSVWWSGNPCNMHLMEMNNKVTESVNRAGLKGMQFNSIGVSDGITNGTDGMRYSLQSREIIADSFETMMMAQMYDANIAIPLCDKNMPGTLMAMGRHNRPSIMVYGGTIMPGSPTCGNSIIPDKIDIISAFQSYGQFLSDQINEGERKDIIKNACPGAGACGGMYTANTMASAAEVLGMSLPFSSSAPAISKEKAHECATVGDAIKNLLVLDLKPMDIMTKKAFENAITYIIATGGSTNAVLHLIAMANTVGVDLTVDDFQRISDSTPLLADFKPSGKYVMADLQKYGGTPAVMKLLFEEGLIDGSQYTVTGKTIKENLESVKGLPAEQEIVRPLSNPLKPSGHLQILKGTLAPGSAVGKITGKEGTYFKGKSRVFDDEMAFITALENGEIKKGEKTVCVIRYEGPQGGPGMPEMLKPSSALMGYGLGQDVALLTDGRFSGGSHGFLIGHIVPEAAVGGPIALVHDGDEIVIDAENNRIDLLVSEDILAERKKEWTPPKPRYTRGTLAKYSKLVSDASLGCVTDLV

SEQ ID NO: 453 - DNA, 1794 bp, Lodderomyces elongisporus
atgagtttcgctagcaccacaagaaggtgttgcactagatcttttgcctcctccactgttcgtcatgaattagaaaagaaaccattgaaactcaacaagtactcttccgttgtcaccgaggacccttcccaaggagcatcgcaagcaatgctctacgccacagggttctcctccgaggactttaaccgtgcacaaatcggtgtcggatccgtttggtggaccggtaacccttgtaacatgcacttgatggagttaaacaatatgtgtgcagagtcagtcaacaaggccggtttaaaagcaatgcaattcaactcaattggtgttagtgatggtatcaccaacggtacagagggtatgaaatactcattgcaatcacgtgaaatcattgctgactcatttgaaacaatgaccatggctcaattatatgacggtaatgttgccatcccaagttgtgacaagaatatgcccggtgtccttatggcaatgggtagacacaatagacccgccattatggtgtacggaggtacaatcatgcccggctcaccaacttgcggtggctcaaagctgaatcccgccattgcagataagattgacattatcagtgctttccaaagttatggacaattcttgtccaaacaaatcaacgaggaagaaagaattgatattgtgaaaaacgcatgtcctggaccaggtgcttgcggtggtatgtacactgccaacactatggcctctgcagccgaagtcttgggtttaactttacctttttcatcatcggcaccagcagtttcaaaagaaaaggccgaagagtgtgccaacgttgggtacgccatcagaaacttgcttgaactcgacttgaaaccaagagacattttgaccaaaaaatcatttgaaaacgccatcacatacatcattgctaccggtggctcaacaaatgcagttttgcacatgattgccattgcttcaagcttcgatatcgaattaactgttgacgatttccaaagaatcagtgactctactccacttttggctgactttaaaccatctggtaaatacgttatggcagatttgcaagctattggtggtacaccagcagttatgaagtttttgatgaatgaaggtatgattgatggttcgcaattgactgtgacaggtaagaccattgctgaaaacttggccaatgttccagaattgccaaagggtcaagaaatcatccactcattggacaacccattgaaaccaagcggtcacttgcaaatcttgaaaggaaccttggccccaggctcagccgttgccaagattactggtaaagaaggtacttacttcaaaggtaaagctagagtttttgacgaggaacacgcatttatcactgcattggaaaatggcgagatcaaaaagggtgaaaagactgtttgtgtcattagatacgaaggaccaaaaggtggtccaggtatgccagaaatgttgaaaccatcaagtgctttgatgggatacggattgggacaagatgttgccttattgaccgatggtagattttctggtggttcacacggattcttgattggtcacattgtccccgaggcagccgaaggtggtccaattgctcttgttgaggatggcgatgagattgttattgatgccgacaagaacatcattgacttgttggtgagcgaagacgtcttggccaagagaagagagcaatggactccacctgaacccagatacaaaagaggtacattgttcaaatatgccaaattggttagtgatgcttccaaaggatgtgttactgacttgtaa

SEQ ID NO: 454 - protein, 597 aa, Lodderomyces elongisporus
MSFASTTRRCCTRSFASSTVRHELEKKPLKLNKYSSVVTEDPSQGASQAMLYATGFSSEDFNRAQIGVGSVWWTGNPCNMHLMELNNMCAESVNKAGLKAMQFNSIGVSDGITNGTEGMKYSLQSREIIADSFETMTMAQLYDGNVAIPSCDKNMPGVLMAMGRHNRPAIMVYGGTIMPGSPTCGGSKLNPAIADKIDIISAFQSYGQFLSKQINEEERIDIVKNACPGPGACGGMYTANTMASAAEVLGLTLPFSSSAPAVSKEKAEECANVGYAIRNLLELDLKPRDILTKKSFENAITYIIATGGSTNAVLHMIAIASSFDIELTVDDFQRISDSTPLLADFKPSGKYVMADLQAIGGTPAVMKFLMNEGMIDGSQLTVTGKTIAENLANVPELPKGQEIIHSLDNPLKPSGHLQILKGTLAPGSAVAKITGKEGTYFKGKARVFDEEHAFITALENGEIKKGEKTVCVIRYEGPKGGPGMPEMLKPSSALMGYGLGQDVALLTDGRFSGGSHGFLIGHIVPEAAEGGPIALVEDGDEIVIDADKNIIDLLVSEDVLAKRREQWTPPEPRYKRGTLFKYAKLVSDASKGCVTDL

SEQ ID NO: 455 - DNA, 1764 bp, Vanderwaltozyma polyspora
atgactattgcaagcaaggcattgagtgctagacacttttcagtcactagaaatgttagtaagaagttgaataagtactcttatatcgttacagaacctaaggaccaaggtgcatcacaagcgatgctttatgcaactgggttcaagaaagaagattttagtaaaggtcaagttggtgtaggatcatgttggtggtctggtaatccatgtaatatgcatttattggatcttaatgatagatgttcacgttctgtggagaaggctggcttgaaagctatgcaatttaataccattggtgtttccgatggtatttcaatgggtactaaaggtatgagatactctttacagagtagagaaatcattgctgattcttttgaaactataatgatggctcaacattacgatgccaatattgctatcccttcatgtgataaaaacatgccgggtgtcatgatggccatgggaagacataacagaccttctatcatggtttatggtggtactattttacctggccatccaacctgtggttcttcaaaaattccagaaaacattgatatagtatctgctttccaatcttatggtcaatatatatctaaacaattcagcgaacaagagagagaagatgtggttgaacatgcttgtcctggtccaggttcttgtggtggtatgtatactgctaacactatgggttctgtcgcagaagtgctaggtttgactttgccaaactcttctgccttcccagcagtttctcaagaaaagatgaatgaatgtgattccattggtgaagctattaagaagacaatggaattaggtatcactcctcgtgatatcatgactaagcaagcttttgaaaatgcaatcacctatgttatcgcaaccggtggttccaccaatgctgttttgcacttggttgccattgctcattctgctggtgtcaagattactcctgatgatttccaaagaatcagtgataagaccccattattgggtgattttaaaccatcgggtaaatacgttatggctgatttaatcaaagtaggaggtacccaatctgttatcaaattcttgtacgaaaacggtttcttgcatggtgatgccattactgttactggtgatacattagccgaacgtgctgccaaaacttctggattaccagaaggccaagatataatcagacctgtttcacaacctattaaaccaaatggccatctacaaatattgtatggctcattggctccaggtggtgctgtcggtaaaatcactggtaaagaaggtactttctttaaaggtagggctcgtgtttttgaagaagaagaagctttcattcatgcattggaaagaggtgaaattaagaaaggtgaaaaaaccgttgttgtcatcagatatgaaggtccaaaaggtggtccaggtatgccagaaatgttgaaaccatcctctgcgctaatgggttacggtttaggtaaagatgttgccttgttaactgatggtagattttctggtggttcccatggattcttaatcggtcacattgttccagaagctgccgaaggtggtccaattggtttagttaaagatggagacgaaattgttattgatacaaataacaacaagatagatttattagtatccgaacaagaaatagcccaacgtaaatcagagtgggttaaaccagctccacgttacaccagaggtactctatccaagtacagtaaattggtatctaacgcttctaacggttgtgtattagacgctgacaattga

SEQ ID NO: 456 - protein, 587 aa, Vanderwaltozyma polyspora
MTIASKALSARHFSVTRNVSKKLNKYSYIVTEPKDQGASQAMLYATGFKKEDFSKGQVGVGSCWWSGNPCNMHLLDLNDRCSRSVEKAGLKAMQFNTIGVSDGISMGTKGMRYSLQSREIIADSFETIMMAQHYDANIAIPSCDKNMPGVMMAMGRHNRPSIMVYGGTILPGHPTCGSSKIPENIDIVSAFQSYGQYISKQFSEQEREDVVEHACPGPGSCGGMYTANTMGSVAEVLGLTLPNSSAFPAVSQEKMNECDSIGEAIKKTMELGITPRDIMTKQAFENAITYVIATGGSTNAVLHLVAIAHSAGVKITPDDFQRISDKTPLLGDFKPSGKYVMADLIKVGGTQSVIKFLYENGFLHGDAITVTGDTLAERAAKTSGLPEGQDIIRPVSQPIKPNGHLQILYGSLAPGGAVGKITGKEGTFFKGRARVFEEEEAFIHALERGEIKKGEKTVVVIRYEGPKGGPGMPEMLKPSSALMGYGLGKDVALLTDGRFSGGSHGFLIGHIVPEAAEGGPIGLVKDGDEIVIDTNNNKIDLLVSEQEIAQRKSEWVKPAPRYTRGTLSKYSKLVSNASNGCVLDADN

SEQ ID NO: 457 - DNA, 1746 bp, Ashbya gossypii
atgatgtctcacaggcggttctcgacagcgcagcggctgcgcgaggggctaaacaggtactcgagggtcataaccgagccgcgggcgcagggtgcctcgcaggccatgctgtacgcgactggtttcggtgatggggactttgcaaaggcgcaggtcggagtggggtcgtgctggtggtcgggcaacccatgcaacatgcatctgatggacctgaataaccgggtagcggcgtctgtggaccgggcgggcttgaaggcgatgcagttcaacacaatcggtgtctcggacggcatttctatggggactaccggcatgcggtactcgctgcagtcgcgcgagatcattgcagactcttttgagaccatgatgatgggtcagcactacgatggcaacgtggcaattccctcctgcgacaagaacatgcccggcgtgataatggccatggcgcggcacaaccggccctccattatggtctacggcggcaccatcatggcggggtccccttgcagcggctctacgcggctgccaaagaagattgatgttgtatctgcgttccaggcgtacgggcaatatctgtcgaagcagattacggaggaggaaagcagggatgtcgtccgtcacgcctgtccgggtccgggctcttgcggtggcatgtacacagccaacacaatggcctcagccgccgaggttctgggactgactctgcccaactcgtctgcgttcccggcgatctccgaacagaagctggccgaatgtgacgccgttggggatgccatgcgcaaagcgctcgagctcaacatcaggccacgcgacctgctcacaagggaagccttcgaaaacgcgatcacgtacgtgattgcgactggtggctcgaccaacgcagtgctccacctggttgctattgcccactctgcgggcgtgaaactgacgccggatgacttccagcgcatttccaacaaaactccgttgctgggcgacttcaagccatccggaaagtacgtcatggctgacctcattgaggttgggggtacacaggccgtcatcaagtttttgtatgaaaatggcttcatgcacggagatgccctaacggtgacaggagacacgctcaaggagcgggctgcgaagactgctcccttgcccgaaggccaggacatcattcgtcccgtgtcgcagccattgaatcctaggggacatctccagattctctatggctctcttgcgccaggcggcgctgtcggcaagatcaccgggaaggaggggaccttcttccagggccgcgcacgcgttttcgatgaagaaaacgcattcatccgcgccctggaggagggccagatcaagaagggtgagaaaaccgttgtggtcatcaggtatgaaggccccaagggtgggcccggcatgccagaaatgctcaaaccgtcttccgcgctgatgggctacggtctgggcaacgatgttgccttgctgaccgacggccgcttctccggcggctcccacgggtttttgatcggccacattgtccctgaggcctatgaaggcggcccaattgcgctcgtgcaagacggtgacgacattgtcatcgacgccgagaacaatgccatcaacctccttgtgccaaaagaagaaattgagtcgcgccgcgctcgctggacccagccggctccacgctacaagaggggcacgctcgccacctattctaagttagtctccaacgcctccaagggttgtgtcttggacagcgacgactag

SEQ ID NO: 458 - protein, 581 aa, Ashbya gossypii
MMSHRRFSTAQRLREGLNRYSRVITEPRAQGASQAMLYATGFGDGDFAKAQVGVGSCWWSGNPCNMHLMDLNNRVAASVDRAGLKAMQFNTIGVSDGISMGTTGMRYSLQSREIIADSFETMMMGQHYDGNVAIPSCDKNMPGVIMAMARHNRPSIMVYGGTIMAGSPCSGSTRLPKKIDVVSAFQAYGQYLSKQITEEESRDVVRHACPGPGSCGGMYTANTMASAAEVLGLTLPNSSAFPAISEQKLAECDAVGDAMRKALELNIRPRDLLTREAFENAITYVIATGGSTNAVLHLVAIAHSAGVKLTPDDFQRISNKTPLLGDFKPSGKYVMADLIEVGGTQAVIKFLYENGFMHGDALTVTGDTLKERAAKTAPLPEGQDIIRPVSQPLNPRGHLQILYGSLAPGGAVGKITGKEGTFFQGRARVFDEENAFIRALEEGQIKKGEKTVVVIRYEGPKGGPGMPEMLKPSSALMGYGLGNDVALLTDGRFSGGSHGFLIGHIVPEAYEGGPIALVQDGDDIVIDAENNAINLLVPKEEIESRRARWTQPAPRYKRGTLATYSKLVSNASKGCVLDSDD

SEQ ID NO: 459 - DNA, 1704 bp, Laccaria bicolor
atgaaccggcacagcagggtggtcacccaacccaaagaccaaggtgctagtcaggccatgctgtatgctacggacggcatcaaaacggatgatgacttcaacaaagccatggtcggcgtcgccagcgtctggtacgagggtaatccatgcaataaacatctccttggtctgggtcaagaaatcaaagcttcacttacaaagtctggtatcataggctaccagtttggtaccgttggagtcagcgatgggatcagcatgggaacgcgcggcatgtcctactccctccaatcccgagacctgattgcagatcaagtagagaccgctgccggaggacaccatctcgacgggatggtcgtcgttcccggctgcgataaaaatatgcctggtgttctgatggcccttgggcgtctcaaccgccctggacttatggtgtatggtgggacaattcgtgccgggtcgtgtgaaggagcgccacagttggacatcgtgtccgctttccagtcctacggaaagtacctgcaggacggaaagacacccgaagcggaacgcgaacgatataataccgttcgacatgcctgcccaggaccaggcgcttgtggtggtatgtacacagcaaacactatggcaagtgcggcggaggcactggggatgacagtccccggatcatcatccttcccagccgaatccctggaaaaacacaacgagtgtgcttcgattgggaaagttatgtacaaccttcttgagaaaaacatacttccacgggatatcatgactagatccgcgtttgaaaatgctatggtcctcacgatgattctaggcggttccaccaatgcagttctccatctaatagctatggctcactccgtgggcattaaattggatatcgacgacttccaaaacgtgtcagaccgcacccccttcctcgccgacatcaaacccagtggcaaatatgtcatggaagatgtgtacaagatcggtggaatcccaaaaattttggcgttcttgctaaagaacaagctaatcgacggaaataatatgactgtcacgggtcgaaccctcggcgaaaaccttgaggaatggacacacagatacggcgaactggattctcgacaagacgttattcgacctctcaacaaacccataaaagagacagggcacatccgaatcctcaaaggcaatcttgctcctggcggtgcggtggctaagatcacaggcaaagaaggcttggaatttactggcaaggcacggactttcgacacagaagacgatttcgtcaaggccgtcgaaagcgggtctatcaaaaagggtgaaaaaacggtcgtcattcttcggtatctcggccctcagggaggacctggcatgcctgagatgctgaaacccacaagcttaatcatgggagccggcttgggattggacgttgcctgtctcacagatggaagattcagcggcggatcccatgggttttgtattggacacgtcgttcccgaggcacaggttggtgggcccatagcgctcgtcagggacggagacaccattgtcgtcgatgccatcaagaacactatcgagctccgcgtctcacccgaggagttaacgaagagaaaagagtcttggattccacctgccctcaaggtatcccagggaacgttgtacaagtatactaagagtgttacagacgcgagccatgggtgtgtgacggacgcatga

SEQ ID NO: 460 - protein, 567 aa, Laccaria bicolor
MNRHSRVVTQPKDQGASQAMLYATDGIKTDDDFNKAMVGVASVWYEGNPCNKHLLGLGQEIKASLTKSGIIGYQFGTVGVSDGISMGTRGMSYSLQSRDLIADQVETAAGGHHLDGMVVVPGCDKNMPGVLMALGRLNRPGLMVYGGTIRAGSCEGAPQLDIVSAFQSYGKYLQDGKTPEAERERYNTVRHACPGPGACGGMYTANTMASAAEALGMTVPGSSSFPAESLEKHNECASIGKVMYNLLEKNILPRDIMTRSAFENAMVLTMILGGSTNAVLHLIAMAHSVGIKLDIDDFQNVSDRTPFLADIKPSGKYVMEDVYKIGGIPKILAFLLKNKLIDGNNMTVTGRTLGENLEEWTHRYGELDSRQDVIRPLNKPIKETGHIRILKGNLAPGGAVAKITGKEGLEFTGKARTFDTEDDFVKAVESGSIKKGEKTVVILRYLGPQGGPGMPEMLKPTSLIMGAGLGLDVACLTDGRFSGGSHGFCIGHVVPEAQVGGPIALVRDGDTIVVDAIKNTIELRVSPEELTKRKESWIPPALKVSQGTLYKYTKSVTDASHGCVTDA

SEQ ID NO: 461 - DNA, 1797 bp, Coprinopsis cinerea
atgccgccaaaatatctcccaattcgtcgtcaatggctccggtcagcgagaggcttgtctacaaccgcacggtgcagtgacaagcccgtcctgaaccggtacagcaggatcatcacccagcccaaggaccagggagcaagtcaggctatgctctatgctacagatggcataaagtcggacgcggacttcaacaagccgatggtcggtgtcgccagcgtatggtatgagggcaacccatgcaacaagcaccttctcggacttggccaggaaatcaaggcttcccttaccgaggcagacatcataggctaccagtttggtacggtcggtgtcagcgacggtattagtatgggtacgaaaggaatgtcgtattccctccagtcgcgagacttaatcgctgaccaggtggaaactgctgccggaggtcatcatctcgatggcatggtagtagtccctgggtgcgacaagaatatgcctggtgttctcatggctcttggccgtctcaaccgaccaggtctcatggtctacggtggaaccattcgcgcaggctcgtgtgaaggcatgcctcaattggatatcgtttctgctttccaggcctacggaaaataccttcaagacggaaggacacccaaggctgaggaagaacgatacaacaccgttcgacacgcctgtcctggtcctggtgcttgcggtggcatgtacactgcaaacacaatggcaagtgcagcggaggctttgggaatgacccttcccggttcttcctccttcccagcgcagtcagaggagaaacatctagagaccaagtctatcggttctgtgatgtacaacttgcttgagaagaacattttgccgagggacatcatgacgcgctctgcctttgaaaacgcgatggtcctcaccgtcatcctcggaggctcaaccaacgcagtcctccatttgatcgccattgctcactcagtcggcatcaaactcgacattgacgacttccaaaaggtgtccgaccggatacccttccttgccgacttgaagcccagcggaaaatatgtcatggaagatgtctacaagatcggtggtatccccaaggttctcgcgttcttgctcaagaacaatttgatcgatggtaataacatgactgttactggtcgcactgtcggagagaacttggaccgatggacgcacaagtacggcgagctccacttcgacaagcaggatgtcatccgacctctggataagcctatcaaggagactggtcacatccggattttgaagggtaacctcgcccctggtggcgccgtcgccaaaatcaccggaaaagaaggccttggtttcgtcggcaaagcacgtgtatttgattctgagaacgacttcgtcaaggctgtggaatctggtagcatcaagaagggcgagaaaaccgttgttattttgcggtatctcggtcctcagggtggacctggaatgcccgagatgcttaagcctaccagtttggtgatgggcgctggattgggtatggatgtcgccatcttgactgacggacgatttagcggaggatcgcacggattctgtatcggacacgtcgttccggaagcgcaagtcggtggccctatcgccttggtcgaggacggcgacatcatctcggttgacgctgtgaagaacacgatcgagttgcaggtccctgaacccgagcttgccgcgcgaaaggctgcatggaaggcaccccctctcaaggtcacccagggcaccctctacaaatacgccaaggttgtcaccgatgccagccatgggtgtgtcactgatgcttaa

SEQ ID NO: 462 - protein, 598 aa, Coprinopsis cinerea
MPPKYLPIRRQWLRSARGLSTTARCSDKPVLNRYSRIITQPKDQGASQAMLYATDGIKSDADFNKPMVGVASVWYEGNPCNKHLLGLGQEIKASLTEADIIGYQFGTVGVSDGISMGTKGMSYSLQSRDLIADQVETAAGGHHLDGMVVVPGCDKNMPGVLMALGRLNRPGLMVYGGTIRAGSCEGMPQLDIVSAFQAYGKYLQDGRTPKAEEERYNTVRHACPGPGACGGMYTANTMASAAEALGMTLPGSSSFPAQSEEKHLETKSIGSVMYNLLEKNILPRDIMTRSAFENAMVLTVILGGSTNAVLHLIAIAHSVGIKLDIDDFQKVSDRIPFLADLKPSGKYVMEDVYKIGGIPKVLAFLLKNNLIDGNNMTVTGRTVGENLDRWTHKYGELHFDKQDVIRPLDKPIKETGHIRILKGNLAPGGAVAKITGKEGLGFVGKARVFDSENDFVKAVESGSIKKGEKTVVILRYLGPQGGPGMPEMLKPTSLVMGAGLGMDVAILTDGRFSGGSHGFCIGHVVPEAQVGGPIALVEDGDIISVDAVKNTIELQVPEPELAARKAAWKAPPLKVTQGTLYKYAKVVTDASHGCVTDA

SEQ ID NO: 463 - DNA, 1791 bp, Cryptococcus neoformans
atgctttcaagacgcatcgctactgcaagcccagccgctcatactagagcattccatgcgtcggctgccaaggcctcgaaagaggtcataatgaatcgttactctaggactattactcaacctaaggctcaaggcgcttctcaggccatgctttacgccacggaaggcattgtgaatgacgaagacttcaataaggccatggttggcgttgccagtgtttggtacgaaggcaacccatgcaatcgacacattttgggccttggccagagggtgaagaagtctcttatgaatgctggcatcgttggctaccaatttggtactgtcggtgtctctgacggtattagcatgggtacctctggaatgtcttactccctgcaatctcgtgacctcattgccgactctgttgagacggctgctggtggtcattggctggatgggatggtcgttttacctggttgcgataaaaacatgcctggtgctttgattgctctcggtcgacttaatcgacccagtatgatggtttatggcggtactatccgtcctggctcttgtggcggagaggtgctcgacattgtgtcagctttccagagttatggacgatacctccaagaaggccaaacacctgaggctgaaaagacccgctacaataccattcgaaacgcatgtcctggtcctggagcctgtggaggcatgtacactgctaacacaattgcgtccgcctccgaagccttgggtatgactcttcctgggtcgtcgtctttccctgcggaatatcctgaaaagcatgcggaatgtgacgctgttggcgagactatgcgcaaggttttggaagataaccttctccccagacaaatcatgaccaggcaggctttcgaaaatgcaatggctcttacaatggcgctcggtggatctaccaacgttgttctccatttgatcgccatcgctcggtcggttggtatcaaccttaccattgacgatttccaaacggtctccgatcgagtacctttgctggccgatctcaaacccagtggtaaatacgttatggaagacatcaacaccatcggtggcacgccttccgtcattcactatctgatcaaaaacggaattatgaccggtgacgagatgaccatcaccggtaagactcttggagagaattgtgatcgctgggtggaggagcacggtagcaagtgggaaggacagaagattttgcgacctattaacgatcctcttaagtccactggacacatccgaattctgcgcggtaatcttgcccctggaggtgctgtctctaagatcacaggcaaagaaggcttgcgctttaccggtaaatgccgggctttcgatgatgaggagggcttcgtgaaggccgtcgaaagcggttctatcaaaaagggagagaaaactgttgttgtcttgaggtaccttggccccaagggcggacctggtatgcctgaaatgctcaaacctaccagtttgatcatgggcgctggtctaggatatgatgtcgcttgtctgacagatggacgatttagcggaggttctcatggcttcgttgttggccatgtcgttccggaggcccaggttggaggacccattgctttggttcaagacggcgatgttattcatattgatgccgttgcgaacactttgtctgtggacgtatccgacgaagagatggcccgcagaaaggagaactgggttgcccctcctctcaaggtcactcacggaacattgctcaaatacgcccgagctgttaccgatgcttctcatggatgtgtcacggatgcttaa

SEQ ID NO: 464 - protein, 596 aa, Cryptococcus neoformans
MLSRRIATASPAAHTRAFHASAAKASKEVIMNRYSRTITQPKAQGASQAMLYATEGIVNDEDFNKAMVGVASVWYEGNPCNRHILGLGQRVKKSLMNAGIVGYQFGTVGVSDGISMGTSGMSYSLQSRDLIADSVETAAGGHWLDGMVVLPGCDKNMPGALIALGRLNRPSMMVYGGTIRPGSCGGEVLDIVSAFQSYGRYLQEGQTPEAEKTRYNTIRNACPGPGACGGMYTANTIASASEALGMTLPGSSSFPAEYPEKHAECDAVGETMRKVLEDNLLPRQIMTRQAFENAMALTMALGGSTNVVLHLIAIARSVGINLTIDDFQTVSDRVPLLADLKPSGKYVMEDINTIGGTPSVIHYLIKNGIMTGDEMTITGKTLGENCDRWVEEHGSKWEGQKILRPINDPLKSTGHIRILRGNLAPGGAVSKITGKEGLRFTGKCRAFDDEEGFVKAVESGSIKKGEKTVVVLRYLGPKGGPGMPEMLKPTSLIMGAGLGYDVACLTDGRFSGGSHGFVVGHVVPEAQVGGPIALVQDGDVIHIDAVANTLSVDVSDEEMARRKENWVAPPLKVTHGTLLKYARAVTDASHGCVTDA

SEQ ID NO: 465 - DNA, 1833 bp, Ustilago maydis
atgctgcgatccgccctcagtccctcagcacgttgcgtcctgcgcggcggcctcgcctcccgccgcgctctccacacctcctcagccgctctcaacacagagcgcgctccgccgggcgctctaaacaagtactcgcgtatcatcacccggcccaaggatcagggagcatcgcaagccatgctctacgccaccgacggcatccagtcggacgaggacctcacgcgtgctatggttggtatcggctcgatttggtacgagggcaacccatgcaacgcgcacctgctcgccatctcgcagcgcgtcaaaaagtcggtgcagcaagccggtctcaccggttatcagtttggatctgtcggtgtttcggatggtatctcgatgggtacagacgccatgtcgtactcgctcccgtcgcgtgatctgatcgctgactcggtggaatcggcttgcggtggtcattggcttgatggctgtgtggtgattcccggttgcgacaagaacatgcctggtgtgctgatggctctcggccgtctgaatcgtcccggaatcatgctctacggcggaacgatccgtcccggtggatgtgctagcgtcgagggcacgctcgacattgtctctgctttccagtcgtacggccagtacctcgccaacggaggctctccggctgctgaaaagattcgctatgacaccgtccgcaacgcctgtcccggtcccggtgcgtgcggtggcatgtacaccgccaacaccatggcttcatgcgccgaggctctcggcatgacgctcccaggtagctcgtcgttcccggcagaataccctgaaaagatcgccgaagccgaaaatatgggagccgccatgcgcctcgtcctcgaaaaggacatcaagccgcgcgacatcatgacgcgatccgccttcgaagatgcgatcgctctcaccatggttctcggaggcagcacgaatgcagtcttacatctgattgctgtcgctcactcggtcggcatcgagctcagcattgacgacttccagcgcatcgccgacgtgactccattccttgccgacctcaagccgtcgggcaagtacgtgatggaagatgttcactcgaaactcggcggtatcccgacgattattcagtactgcatcgagaacaagctgatgaagggtgaacacatgaccgtcaccggtcgaacgcttgccgagaacgtcgaccgatggacgcacgagcgcggcaaactgcctgcaggccaagacgtgctccgaccgatcgacaagcctctcaagagcaccggccacattcgaatcctcaagggcaatcttgcgcctggtggcgccgtcgccaagatcactggaaaagagggtctgcgattcacaggtaaagcgcgcgtctttgacaccgaagatgccatggttggcgccgttgaaaagggcgagatcaagaagggtgaaaagacagtgatcgtgttgcgctacaagggtcctaagggtggacctggtatgcccgagatgctcaaacctaccagtttgatcatgggcgctggtcttgggcaggatgtagcctgtttgaccgacggtcggttctccggtggaagtcacggtttcgtcatcggtcacgtcgttcccgaggcacaggtcggaggtccgatcggcctcgtaaaggatggtgatgtgatcagcatcgatgccgagaccaacacgttggagcttgtcggtgtatccgctgccgatctcgagtcccgaagagagtcgtggaagcctctaccgctcaaaccgaaatcgggccacctgctcaagttcgttcgtaacgttgccgatgcttcgcatggttgcatcaccgatatgtga

SEQ ID NO: 466 - protein, 610 aa, Ustilago maydis
MLRSALSPSARCVLRGGLASRRALHTSSAALNTERAPPGALNKYSRIITRPKDQGASQAMLYATDGIQSDEDLTRAMVGIGSIWYEGNPCNAHLLAISQRVKKSVQQAGLTGYQFGSVGVSDGISMGTDAMSYSLPSRDLIADSVESACGGHWLDGCVVIPGCDKNMPGVLMALGRLNRPGIMLYGGTIRPGGCASVEGTLDIVSAFQSYGQYLANGGSPAAEKIRYDTVRNACPGPGACGGMYTANTMASCAEALGMTLPGSSSFPAEYPEKIAEAENMGAAMRLVLEKDIKPRDIMTRSAFEDAIALTMVLGGSTNAVLHLIAVAHSVGIELSIDDFQRIADVTPFLADLKPSGKYVMEDVHSKLGGIPTIIQYCIENKLMKGEHMTVTGRTLAENVDRWTHERGKLPAGQDVLRPIDKPLKSTGHIRILKGNLAPGGAVAKITGKEGLRFTGKARVFDTEDAMVGAVEKGEIKKGEKTVIVLRYKGPKGGPGMPEMLKPTSLIMGAGLGQDVACLTDGRFSGGSHGFVIGHVVPEAQVGGPIGLVKDGDVISIDAETNTLELVGVSAADLESRRESWKPLPLKPKSGHLLKFVRNVADASHGCITDM

SEQ ID NO: 467 - DNA, 1770 bp, Malassezia globosa
atgtcgacgacatgtgcttgcaccacagcaaagaaggatcgcccagcaccaggtgatctgaatcggtactcgcgcttgataacgcaaccaaaagatcagggtgcatcacaggcaatgttgtatgccacgcacggaatccagtcagatgaggatttacgacgtgccatggttggcgtggccagtgtctggtacgaaggcaacccatgcaacgcgcacttgctgggcgttggacagcgaattcgagattctctcgacagggccggcctgacaggctaccaatttggcacagtcggcgtgtctgacggtattagcatgggaaccagtgccatgtcgtactcgcttccgagtcgggatctcattgccgacagcgttgaaagctgcatgggtggccattggcttgatggatgtgttgtggtgccagggtgtgacaagaacatgccgggtgtgctcatggcacttggccgtctgaatcgtccaggcattatggtatatggtggcacgattcgccctggccactgcggatcgatcacaggtacacttgacattgtgagcgcgttccagagttacggacagtacctggcatcaggcggcacgcccgatgccgaaaagatccgctacgacactgtacgtcatgcgtgcccaggaccaggtgcttgcggtggtatgtacacggccaataccatggcatcatgtgcagaggtgctgggtatgacactacccggcagtagctctttccctgccgaatacaacgagaagaaggccgaatgtgacagtattgggccaacgatgcgcatgctgcttgagaagaacattcgcccgcgagatattatgacgcgcagcgcattcgaagatgcaatggtacttacgatggtgctgggtgggtcgacgaatgctgtattgcacctgctcgccatggcccgaagcgtgggcgtagacctatctatcgatgacttccaacgcgtgagtgattcaactccgttccttgccaatctgaagccaagtggccagtacgtcatggaagacgtacacaccgtactgggcggcattccttccgttgtacactacttgattgagaacaaactcatgaaaggtgagcacatgactgtaacgggtcgaacactgcgtgaaaactgtgagcaatgggttgcagagcgcggtcccatgcccaaggaccaagatgttctccgccccatcgacaagccgatcaagcgtacaggccacatccgtgttctttacggcaacctagctcccggtggtgctattgccaagatcacaggcaaggaaggtctcgaatttacagggaaagcacgcgtatttgacacggaagatgacatggtgcatgctgtcgagcaagggacgatcaaaaagggcgagaagactgtggtgatacttcgctacaaaggtcccaagggcggtccagggatgcctgaaatgctcaagccaacgagtttgatcatgggcgcaggtctcggtcacgacgttgcttgcctcacagacggccgctttagcggcggttcgcacggcttcgtgattggacatgtcgttcccgaagcacaagagggtgggccgattgcccttgtgcgggatggcgatgaaatcactatcgatgcggtgaacaactcgatccagatcaacaatgtctcagacgaggagctcgcgcagcgccgcgccgcttggcaaccccggcctcttacagtcaaccagggcggcttgtataaatacacgcgactcgtatcaaacgcaagtcagggctgtgtgacagatgcatga

SEQ ID NO: 468 - protein, 589 aa, Malassezia globosa
MSTTCACTTAKKDRPAPGDLNRYSRLITQPKDQGASQAMLYATHGIQSDEDLRRAMVGVASVWYEGNPCNAHLLGVGQRIRDSLDRAGLTGYQFGTVGVSDGISMGTSAMSYSLPSRDLIADSVESCMGGHWLDGCVVVPGCDKNMPGVLMALGRLNRPGIMVYGGTIRPGHCGSITGTLDIVSAFQSYGQYLASGGTPDAEKIRYDTVRHACPGPGACGGMYTANTMASCAEVLGMTLPGSSSFPAEYNEKKAECDSIGPTMRMLLEKNIRPRDIMTRSAFEDAMVLTMVLGGSTNAVLHLLAMARSVGVDLSIDDFQRVSDSTPFLANLKPSGQYVMEDVHTVLGGIPSVVHYLIENKLMKGEHMTVTGRTLRENCEQWVAERGPMPKDQDVLRPIDKPIKRTGHIRVLYGNLAPGGAIAKITGKEGLEFTGKARVFDTEDDMVHAVEQGTIKKGEKTVVILRYKGPKGGPGMPEMLKPTSLIMGAGLGHDVACLTDGRFSGGSHGFVIGHVVPEAQEGGPIALVRDGDEITIDAVNNSIQINNVSDEELAQRRAAWQPRPLTVNQGGLYKYTRLVSNASQGCVTDA

SEQ ID NO: 469 - DNA, 1824 bp, Aspergillus clavatus
atggatgcctccaaccccgcgctgtccagcacatccgaagcaaaatatatcaacttccccagtcttcccgatgacgcaaaacacgacgacggcacgcttgcgctgaatagatactcgtcctatatcactcgcggccatgacttccctggtgcccgggcaatgctgttcgcggcgggtatcccagatcgcgatgccatgacaaagagcccccaggttggtgttgccagtgtctggtgggagggaaacccgtgcaacatgcacctgttggatttgggcaagacggtcaagaaagccgtcacggagcagggcatgatcggatggcagtataacacgattggggtttcggatgggattacgatgggtagtgatgggatgcgattttctctgcagacgcgcgagatcatcgccgatagtgtcgagacagtgacatgtgcgcagtaccatgatgcctgtattgccatccctggatgtgacaagaacatgcctggcgtggtgatgggcatggcacggcacaatcggccgtcgatcatgatctacggtggcacgattcagatcggctattccaatctcctgcggaagcctatcaacgtgtcgtcttgtttcgaggccgcgggcgcatatgcatacgacactttgcgccaaccggacgacggaggcgataccagcaagaccaaggatgagatcatggatgacctggagagacacgcgtgccccacggcaggcgcctgcggaggcatgttcacggcaaacacgatggccacggcgatcgagtcgatggggctgtctctgcccggatcatcgtcgacacctgcgtcgtcgccatcgaagatgcgggagtgcgtcaaggcggctgaagccatcaaggtctgcatggagaagaacatcaagccccgagatctgttgaccaagcggtcatttgagaacgccctggttatgaccatggcgctgggcggaagcaccaatggtgtcttgcatttcctcgccatggccaggacggccgaggtggatctcaccttggatgatatccagcgagtgagcaataagatccccttcatcgcggatctggctccgagcgggaagtactacatggcggacctgtatgatatcggaggcattccgtctgtgcagaagctgctgatcgcagcgggtctcctcgacggcgatatccccacagtcactggcaagacgttggccgagaacgttgcctccttcccatcgctgcctcaagatcaagtcatcattcgccctctcgataagcccatcaaggcgactgggcacctgcagatcttgcgcggaaacctggcacctggaggagcagtcgccaagatcaccggaaaggagggaaccaaattcacaggcaaagcccgtgtctttaataaggagcatcaattgaacgatgctgtgacccagggcaaaattcctcgtggcgagaacctggtgcttattgtccgttacgaaggccccaagggcggaccgggtatgccggaacagctcaaagccagtgcagcgctcatgggagccaagctcaacaacgtggcgctgatcacagatgggcgatactcaggagccagtcacgggttcatcgtcggccatattgtccccgaagctgcagttggcggaccgattgctgttgtccgtgacggcgatgtgattaccatcgatgcggagaccaacaccatcagcatggatgtttcggacgaggagattcgacagcgtctgaaggaatggaagcccccaacgccccatgtcacacgtggcgtactagccaagtatgccaggctggttggagatgcctctcatggcgcgatgacggatctattctag

SEQ ID NO: 470 - protein, 607 aa, Aspergillus clavatus
MDASNPALSSTSEAKYINFPSLPDDAKHDDGTLALNRYSSYITRGHDFPGARAMLFAAGIPDRDAMTKSPQVGVASVWWEGNPCNMHLLDLGKTVKKAVTEQGMIGWQYNTIGVSDGITMGSDGMRFSLQTREIIADSVETVTCAQYHDACIAIPGCDKNMPGVVMGMARHNRPSIMIYGGTIQIGYSNLLRKPINVSSCFEAAGAYAYDTLRQPDDGGDTSKTKDEIMDDLERHACPTAGACGGMFTANTMATAIESMGLSLPGSSSTPASSPSKMRECVKAAEAIKVCMEKNIKPRDLLTKRSFENALVMTMALGGSTNGVLHFLAMARTAEVDLTLDDIQRVSNKIPFIADLAPSGKYYMADLYDIGGIPSVQKLLIAAGLLDGDIPTVTGKTLAENVASFPSLPQDQVIIRPLDKPIKATGHLQILRGNLAPGGAVAKITGKEGTKFTGKARVFNKEHQLNDAVTQGKIPRGENLVLIVRYEGPKGGPGMPEQLKASAALMGAKLNNVALITDGRYSGASHGFIVGHIVPEAAVGGPIAVVRDGDVITIDAETNTISMDVSDEEIRQRLKEWKPPTPHVTRGVLAKYARLVGDASHGAMTDLF

SEQ ID NO: 471 - DNA, 1827 bp, Neosartorya fischeri
atggactcctctacctccacgtcgtccaacacccagggcgaagccaagtatatcaacttccccagtcttcctgacgacgcaaagcatgaagatggcacccctgcgctgaacagatattcttcttatatcactcggagccatgactttcctggtgctcgggctatgctttttgcagcgggaattccggatcgcgaagcgatggctaagagtccacaggtgggaattgccagtgtctggtgggagggaaatccttgcaatatgcacctgctggacttgggcaagacggtgaagaaggccgttacggatcagggcatgaccggttggcagtataataccattggagtttcagatgccatttcaatgggtagtgagggcatgagattttctctccagtcgcgtgagatcattgcagacagcgtcgagaccgtgacttgtgcgcagtatcatgatgcatgcattgctattcctgggtgcgacaagaatatgcctggagtggtgatgggtatggcgagacacaatcggccttcgcttatgatttacggtggaacaattcaaattggatactcgaacctgctgcgaaagcgggtcaacgtgtcaacttgctttgaagcggctggtgcctatgcctacgatactttgcgtcaaccggacgatgggggtgacaccagtaaaagcaaggacgagattatggatgacattgagagacatgcttgtcccagtgcgggcgcatgtggaggcatgtttactgcaaacacaatggccacggcgattgagtccatgggcctgtccctaccagggtcatcatcaacgcctgcctcgtctccatcgaagatgcgagaatgtgttaaagcggcagaagccatcaagatctgtatggagaagaacattaagcctcgggatcttttgaccaagcgctccttcgagaacgccctcgtcatgacgatggctctgggaggaagtaccaatggtgtcttgcacttccttgccatggctcggacggcggatgtgaacctgaccctagatgatatacaacgggtcagcaacaagatcccattcattgctgacttggcccccagtgggaagtactacatggcagacctgtacgatattggagggatcccgtctgtgcagaagttgctgatcgcagcgggccttcttgacggcgacatccccacggtcaccggcaagaccttggctgagaatgttgcatctttcccatctctacctcaggaccaagtcatcatccgccccctggacaacccaatcaagacgactggccacctgcagattctacgtggaaacctggcgcctggtggagcggtggccaagatcactggcaaggagggcaccaagttcacaggcaaagcacgtgttttcaataaagaatttcagctcaacgatgctctgacccaaggcaagattcctcgaggcgaaaacctggtgctcatcgtccgctacgaaggacccaagggtggaccaggcatgccggagcagctcaaagcgagtgcggcgctgatgggagctaagctcaacaatgtggccctaatcacagatggaagatattcaggggctagtcatggattcatcgtgggtcatatcgtcccagaagctgcggccggaggacccattgccattgttcgcgatgatgatgtgattaccatcgatgcggaaaccaacacaataaacatgcatgtctcagatgaggaaatccagcagcgactgaaagagtggaagcccccagtgcctcatgtcacacgtggtgtactcgccaagtatgcaaggctggttggggacgcctctcatggtgcaatgacggatctgttctag

SEQ ID NO: 472 - protein, 608 aa, Neosartorya fischeri
MDSSTSTSSNTQGEAKYINFPSLPDDAKHEDGTPALNRYSSYITRSHDFPGARAMLFAAGIPDREAMAKSPQVGIASVWWEGNPCNMHLLDLGKTVKKAVTDQGMTGWQYNTIGVSDAISMGSEGMRFSLQSREIIADSVETVTCAQYHDACIAIPGCDKNMPGVVMGMARHNRPSLMIYGGTIQIGYSNLLRKRVNVSTCFEAAGAYAYDTLRQPDDGGDTSKSKDEIMDDIERHACPSAGACGGMFTANTMATAIESMGLSLPGSSSTPASSPSKMRECVKAAEAIKICMEKNIKPRDLLTKRSFENALVMTMALGGSTNGVLHFLAMARTADVNLTLDDIQRVSNKIPFIADLAPSGKYYMADLYDIGGIPSVQKLLIAAGLLDGDIPTVTGKTLAENVASFPSLPQDQVIIRPLDNPIKTTGHLQILRGNLAPGGAVAKITGKEGTKFTGKARVFNKEFQLNDALTQGKIPRGENLVLIVRYEGPKGGPGMPEQLKASAALMGAKLNNVALITDGRYSGASHGFIVGHIVPEAAAGGPIAIVRDDDVITIDAETNTINMHVSDEEIQQRLKEWKPPVPHVTRGVLAKYARLVGDASHGAMTDLF

SEQ ID NO: 473 - DNA, 1827 bp, Aspergillus oryzae
atggatccctccaaccccgccgtctccgcaacctttggggaagcgaaatacatcgaattcccctgtcttccagaggggacgaagcatgaggatggaacacctgcactgaatcgctactctgcaaccatcactagaggccatgacttccctggcgctaaggcaatgctctatgcagcaggtgttcccgaccaaaacgctatggcaaagagtcctcaggtaggagttgcatctgtgtggtgggaaggaaatccgtgtaacatgcacctgctggatatgggcaagacggtaaagaaggccgtcgagggccagggcatgattggttggcaatataacaccattggtgtttcagatgccatcaccatgggcagtgaaggcatgcggttttctctccaaacgcgtgagatcattgcagatagtgtcgagactgtgacttgtgctcagtaccacgatgcctgcattgccatccccggatgcgacaagaacatgcctggagtggtgatgggtatggccaggcataaccggccctccatcatgatctacggcgggactattcagattgggtattccaacctcctacgaaagccaattaacgtttcgagttgcttcgaagccgctggggcttactcatatgatactttgcgtcaaccggacgacggtggagacaccagcaagaccaaggatgagatcatggatgatcttgaaagacatgcctgtcccagcgcgggcgcatgtggaggcatgttcactgcgaacacaatggccacagctatcgagtcgatgggtctgtctttgcctggctcctcttccacccccgctacatctccatcaaaaatgcgagagtgtgtcaaggtggcggaagcgattaaagtttgcatggagaagaatataagaccgcgtgatcttttgactaagcggtcattcgaaaatgccctcgtcatgacgatggctcttggaggaagcaccaacggtgtgctccacttccttgccatggctcggacagctggcgtggaacttactttagatgatattcaaagggtcagtaacaagatcccattcattgctgacctttcccccagtggaaaatactacatggcggacttgtacgatattggcggggtaccgtctgtccaaaagctgttgattgcagggggcctgcttgatggcgatattccaacagttaccggaaagactctggccgagaacgtggcatcattcccatcgttaccggacgatcaggttattattcgtcctttggacaaccctattaaggcgactggccaccttcagatcctccgtggaaacctagcccccggaggcgctgtggccaagatcaccggcaaggagggcactaaatttataggaaaggcacgagtgtttgataaggagtatcaactcaatgatgcactcaaccagggtaaaataccccgagatgagaatttagtgatcatcgtccgttatgagggccccaagggcggaccgggaatgccggaacagctcaaggccagcgcggcattgatgggagccaagcttaccaacgtggcactgatcactgatggaagatactcaggggcaagtcatgggttcatcgtcggccatatcgtacccgaagccgcggtaggaggaccaatcgctgttgtccgcgatggggacgtggtcacaattaatgcggaaaccaacgaaattagcatggatgtctcggatgaagaaatccagcaacggctgagagagtggcaacctcccgcaccgcacgttacacgcggtgtgctggccaagtatgctcggctggttggtgacgcttcccacggcgcaatgacggaccttttctag

SEQ ID NO: 474 - protein, 608 aa, Aspergillus oryzae
MDPSNPAVSATFGEAKYIEFPCLPEGTKHEDGTPALNRYSATITRGHDFPGAKAMLYAAGVPDQNAMAKSPQVGVASVWWEGNPCNMHLLDMGKTVKKAVEGQGMIGWQYNTIGVSDAITMGSEGMRFSLQTREIIADSVETVTCAQYHDACIAIPGCDKNMPGVVMGMARHNRPSIMIYGGTIQIGYSNLLRKPINVSSCFEAAGAYSYDTLRQPDDGGDTSKTKDEIMDDLERHACPSAGACGGMFTANTMATAIESMGLSLPGSSSTPATSPSKMRECVKVAEAIKVCMEKNIRPRDLLTKRSFENALVMTMALGGSTNGVLHFLAMARTAGVELTLDDIQRVSNKIPFIADLSPSGKYYMADLYDIGGVPSVQKLLIAGGLLDGDIPTVTGKTLAENVASFPSLPDDQVIIRPLDNPIKATGHLQILRGNLAPGGAVAKITGKEGTKFIGKARVFDKEYQLNDALNQGKIPRDENLVIIVRYEGPKGGPGMPEQLKASAALMGAKLTNVALITDGRYSGASHGFIVGHIVPEAAVGGPIAVVRDGDVVTINAETNEISMDVSDEEIQQRLREWQPPAPHVTRGVLAKYARLVGDASHGAMTDLF

SEQ ID NO: 475 - DNA, 1827 bp, Aspergillus niger
atggaccccgccaaacctgccgtgtcatccactttgggggaggccaagtaccttgaatttccctgcgtaccagagggcacaaaacacgaagatggtacccccgtcttgaaccgttggtcttctactatcaccaggggccatgagttccctggcgcgaaggctatgctctacgcggcaggcatccccgatcacaatgccatgacgaagagtccccaggttggtgttgcgtctgtgtggtgggaaggcaacccttgcaacatgcacttgttggacctggccaagacggtgaagaaggcgatcacggaccaaggcatgatcgggtggcagtacaatactattggtgtgtcggatgcgattggcatggggagtgaaggtatgcgattttctctccaaacccgtgagatcattgcagacagtgtggagtctgtaacgtgcgctcaataccatgacgcctgcattgccatccccggatgcgacaagaacatgcctggtgtggtgatgggtatggcgagacacaatcggccctcgatcatgctctacggtggtactatcgaggttgggtattcccagcttcttcggaagcgggtaagcgtttcgacgtgcttcgaagcggctggtgcctacacatataacactctccgtcagccggatgacggaggtgataccagcaagaccaaggacgagatcatggatgatctggagaggcatgcctgcccgagcgcgggagcgtgtggtggtatgttcacggccaacaccatggctacggccattgagtccatgggtctctccttgcccggctcgtcttctacgcctgcatcttccccaactaagatgcgtgagtgtgtcaaggcagctgaagccatcaagatttgcatggagaagaacatccgtcctcgggatctgttgaccaagcgggcgttcgagaatgccctggtcatgactatggccctgggaggtagcaccaatggtgtgcttcacttcctggctatggcccgcactgccggcgtggaccttactctggacgacgttcagcgggtcagcaacaagatccctttcattgcggacctgtcccctagtgggaaatactacatggcggacctctacgaagtcggaggcatcccgtcggttcagaagttgttgatcgcagctggtctgctcgacggcgatatccccaccgtgaccggcaaaactctggcccagaacgtcgcatcgcacccatctctgtctgctgaccaggtcatcatccgtcccctggataaccctatcaaggcgacgggccacctccagatcctgcgaggtaaccttgcacccggtggtgcggttgctaagattaccggcaaggaagggctccggttcacgggtaaggcgcgcgtgtttgacaaggagcatcagctcaacgaggccctgaaccagggcaagatccctcacggcgagaacctggttatcgtagttcgttacgagggcccgaagggtggcccgggaatgccggaacaactgaaggccagtgcagcgctcatgggagccaagctcaccaacgtggcactgattacggacgggcggtactctggcgctagtcacggattcattgtggggcatattgtccctgaagctgctgtaggaggacccattgccgttgttcgggacggcgatgtgatcacaattgatgccgaatcgaacgccatcaccatggatgtatcggatgaggaggtgcagcagcgtctgcgggagtggaagcccccggcaccgcatgtcacacgaggtgtgctggccaaatatgcccggttggtgggagatgcctcgaacggagccatgacggatctattttag

SEQ ID NO: 476 - protein, 608 aa, Aspergillus niger
MDPAKPAVSSTLGEAKYLEFPCVPEGTKHEDGTPVLNRWSSTITRGHEFPGAKAMLYAAGIPDHNAMTKSPQVGVASVWWEGNPCNMHLLDLAKTVKKAITDQGMIGWQYNTIGVSDAIGMGSEGMRFSLQTREIIADSVESVTCAQYHDACIAIPGCDKNMPGVVMGMARHNRPSIMLYGGTIEVGYSQLLRKRVSVSTCFEAAGAYTYNTLRQPDDGGDTSKTKDEIMDDLERHACPSAGACGGMFTANTMATAIESMGLSLPGSSSTPASSPTKMRECVKAAEAIKICMEKNIRPRDLLTKRAFENALVMTMALGGSTNGVLHFLAMARTAGVDLTLDDVQRVSNKIPFIADLSPSGKYYMADLYEVGGIPSVQKLLIAAGLLDGDIPTVTGKTLAQNVASHPSLSADQVIIRPLDNPIKATGHLQILRGNLAPGGAVAKITGKEGLRFTGKARVFDKEHQLNEALNQGKIPHGENLVIVVRYEGPKGGPGMPEQLKASAALMGAKLTNVALITDGRYSGASHGFIVGHIVPEAAVGGPIAVVRDGDVITIDAESNAITMDVSDEEVQQRLREWKPPAPHVTRGVLAKYARLVGDASNGAMTDLF

SEQ ID NO: 477 - DNA, 1773 bp, Aspergillus terreus
atggacccctcgactcccgccgtgtcgtccaccatgggcgaggccaaatacatcgaatttcccagtctccccgacgacgcaaaacaccccgatggcacccccgcgctgaaccgctactcaacaaccatcacgagaggccatgactttcccggtgcgaaggccatgctgtatgcggccggcatcccggaccaggaaaccatggccaaagcgccgcacgtcggaatcgcctcggtctggtgggaggggaacccgtgcaacatgcacctgttagatctgggaaagacggtgaagaagtcggtggacgcacagggcatgatcggatggcagtacaacaccattggtgtgtcggacgccattaccatgggcagcgagggaatgcgcttctcgctgcagtcccgcgagatcatcgcggacagcgtcgagacagtcacctgcgcgcagtaccacgacgcgtgcatcgccatccccggctgcgacaagaacatgccgggcgtggtgatgggcatggcgcggcacaatcggccgtcgatcatgatctacggcggcacgatccagatcggctactccaacctgctacgcaagccgatcaacgtgtcgacgtgctttgaggcggcgggcgcctatgcctacgacacgctgcggcagccggacgacggcggcgacacgagcaagaccaaggacgagatcatggacgagctggagcagcacgcgtgcccgagcgcgggcgcgtgcggcggcatgttcacggccaacacgatggcgacggcgatcgagtcgatggggctgtcgctgcccgggtcgtcgtcgacgccggcgtcgtcgccggccaagatgcgcgagtgcgccaaggccgccgacgccatcaagcggtgtctggcgctgaacctccggccgcgcgacctgctcaccaagcgcgcggggcgcccccccgggggtggccccccccctttgagggacatcccagggggtgaggcgaccgcattcccttcattggccaccttttggcccaaggggcaaagttactccatgggcagatctgttcggagattcgggggcgtgcggtccgtgcaggaggttgtttattcgcagccggcctgcttgacggcgccatccccacggtcacgggcaagacccctcgccggagaacgtggcctcggtggccgtccctgcccgccgacccaggtcatcatccgcccgctcgacaaccccatcaagccgacgagccatctgcagattctgcgcggcaacctggcccccggcggcgccgtcgccaagatcaccggcaaggagggcacgcgcttctcgggcaaggccctcgtcttcgacaaggagtaccagctcaacgacgccctgaaccagggccagattccccgcggcgagaacatcgtcatcgtcgtccgctacgagggccccaagggcgggcccggcatgcccgagcaactcaaggcgagcgccgccctgatgggtgcgaagctcaccaatgtggccctgatcaccgatggtcggtactcgggcgcgagccatggcttcatcgtcggccatattgtccccgaggccgcggtgggtggccccattgcggtcgtccgcagcggtgatgtgatcacgattaatgcggaaaccaacgagatcaccatggatgtctcggacgaagagatccagcagcgtctgaaggagtggaagcccccagcacctcatgtcacgcggggcgtgttggccaagtatgcccggttggtgggagatgcttcgcacggtgccatgaccgacctgttttag

SEQ ID NO: 478 - protein, 590 aa, Aspergillus terreus
MDPSTPAVSSTMGEAKYIEFPSLPDDAKHPDGTPALNRYSTTITRGHDFPGAKAMLYAAGIPDQETMAKAPHVGIASVWWEGNPCNMHLLDLGKTVKKSVDAQGMIGWQYNTIGVSDAITMGSEGMRFSLQSREIIADSVETVTCAQYHDACIAIPGCDKNMPGVVMGMARHNRPSIMIYGGTIQIGYSNLLRKPINVSTCFEAAGAYAYDTLRQPDDGGDTSKTKDEIMDELEQHACPSAGACGGMFTANTMATAIESMGLSLPGSSSTPASSPAKMRECAKAADAIKRCLALNLRPRDLLTKRAGRPPGGGPPPLRDIPGGEATAFPSLATFWPKGQSYSMGRSVRRFGGVRSVQEVVYSQPACLTAPSPRSRARPLAGERGLGGRPCPPTQVIIRPLDNPIKPTSHLQILRGNLAPGGAVAKITGKEGTRFSGKALVFDKEYQLNDALNQGQIPRGENIVIVVRYEGPKGGPGMPEQLKASAALMGAKLTNVALITDGRYSGASHGFIVGHIVPEAAVGGPIAVVRSGDVITINAETNEITMDVSDEEIQQRLKEWKPPAPHVTRGVLAKYARLVGDASHGAMTDLF

SEQ ID NO: 479 - DNA, 1827 bp, Coccidioides immitis
atggcttctcaagctcctattgcgcaagatggaccaaacgaggaggcgaaatatatcgacttcccctgtcttcctgatgatgcgatgcgggacggaaaaccggccttgaacaaatattctcagttcattacaaaaggtcatgattacccaggtgcccaggcaatgttatatgctgctggggtacctgatagggatgccatgaaaacgagtcctcatgttggcattgcatcagtatggtgggaaggaaatccctgcaacatgcacttgttggatttaggaaagactgtgaaaaaggctgttatagatcagggcatgctgggatggcaatacaataccattggtgtctctgacgcaatcacaatgggtcatgaaggcatgcgcttttctctgcagtctcgtgagatcattgccgacagcatcgaaactgtgacttgcgcacaataccatgacggttgcattgccatacctggttgtgacaagaacatgcctgggtgtattatggccatgggaagacacaaccgcccctccctgatgatatacggtggtacaattcaaggcggatattcgaaactattgcgacgacccattaacgtttcgacctgctatgaggccgcgggtgcttatgcgtataatactttagtccagccggacgatgggggggacaggagcaaaactaaggatgagatcatggaagacattgaaagacatgcttgtccgagcgctggggcttgcgcaggcatgtatactgcgaacacaatggccacagcaattgagtcgatgggtctgactctgcctggttcatcttctacccccgcaacatcaccagcgaagatgcgagaatgtgtaaaagcggctgatgcaattaaattgtgcatggagaggaacatcagaccgcgcgacttattgacaaaacggtcctttgagaatgccctggtcatgacaatggctctcggtggaagcactaacggcgttgttcatttcattgccatggctagatcggctggtgttcacttaatgctagatgacatccagcgtgttagtgacaaaattccttttatcgcgaacctcgccccaagcggaaaatattacatggcagatctatacgaaattggaggcattccatccgtccagaaattgcttgtcgccgcaggccttttagatggcggtattcccacggtgactggaaagacattggcggagaacattgcatctttcccctccctcccacaagaccaagctatcattcacccacttgacaacccgatcaagtcaaccggccatctccaggtgctcaggggaaaccttgcccctggcggtgctgtcgctaaaattaccggaaaagaaggtactaaatttacgggaaaggctcgcgtatttaacaaagagcacgagttggacgccgctctaagccgtggcgagattccacgcggagataacctcgtcctcgtcgttcgatatgagggaccaaagggtggtcccggaatgccggaacaactcaaagctagtgctgccttgatgggagctaaactcacaaacgtagcgctgattacagatggcagatattcaggtgccagtcatggatttattgttggacacattgtcccagaagctgcagtgggcggtccgattgctgttgtgcaggatggtgatacgatcacaatcaacgcggataccaacgaactcacaatggatgtttctgacgaagaaatcgcacagcgtttgaaggggtggaaaccgccaaaaccacgtgttacccggggggtgctggcgaagtatgctaaattagtcggagatgcatcaaatggtgctatgactgaccagttttag

SEQ ID NO: 480 - protein, 608 aa, Coccidioides immitis
MASQAPIAQDGPNEEAKYIDFPCLPDDAMRDGKPALNKYSQFITKGHDYPGAQAMLYAAGVPDRDAMKTSPHVGIASVWWEGNPCNMHLLDLGKTVKKAVIDQGMLGWQYNTIGVSDAITMGHEGMRFSLQSREIIADSIETVTCAQYHDGCIAIPGCDKNMPGCIMAMGRHNRPSLMIYGGTIQGGYSKLLRRPINVSTCYEAAGAYAYNTLVQPDDGGDRSKTKDEIMEDIERHACPSAGACAGMYTANTMATAIESMGLTLPGSSSTPATSPAKMRECVKAADAIKLCMERNIRPRDLLTKRSFENALVMTMALGGSTNGVVHFIAMARSAGVHLMLDDIQRVSDKIPFIANLAPSGKYYMADLYEIGGIPSVQKLLVAAGLLDGGIPTVTGKTLAENIASFPSLPQDQAIIHPLDNPIKSTGHLQVLRGNLAPGGAVAKITGKEGTKFTGKARVFNKEHELDAALSRGEIPRGDNLVLVVRYEGPKGGPGMPEQLKASAALMGAKLTNVALITDGRYSGASHGFIVGHIVPEAAVGGPIAVVQDGDTITINADTNELTMDVSDEEIAQRLKGWKPPKPRVTRGVLAKYAKLVGDASNGAMTDQF

SEQ ID NO: 481 - DNA, 1788 bp, Paracoccidioides brasiliensis
atgaatcccgaagagaaggtcgatggcttcgaagagccgcgatacatccagttcccttgcctgccggacgatgcgactcgggatggaaagccggtgttgaataaatattctacatttcttacagcgatgttatatggcgcgggggtgccggatcgtgagagcatgaaaaatagcccccaggtcggcattgcgacggtatggtgggaagggaatgcctgtaatatgcaccttttggatctggggaagacggtcaaaaaagccatcacggatcaggggatgctgggctggcaatataacaccatcggtgtctccgatgctatttccatgggtagtgaaggtatgcgatactccctccaatctcgggagatcattgcagacagcatcgagacagtagtaggtgctcaatatcatgatgctgcattgcgattccgttgcgacaagaacatgccaggctgcgtcatgggtatggccagacataacagaccgtctttgatgatatacggtgggacaattcaggtcgggtactccaagttactccgcaggcgaatcaacgtctctacttgctacgaagcagctggcgcgtacgcttacaacaccttaacccagcccgacgacggcggagaccgctcgaggacgaaagatgaaatcatggaagacattgagcgaaatgcctgtcccagcgctggcgcatgcgcgggaatgtacacagcaaacaccctggctaccgcgattgagtcaatgggtttgactctgccaggctcctcgtccaccccagctacggtgcctgccaagatgcgcgagtgcgtaaaagcagcggacgcgatcagaatatgtatggagaagaacattaggccgcgagatctacttacgaaacgctcctttgagaatgcgctggtaataaccatggcgctgggcgggagcacgaacagcatcgttcacctgatagcgatggccagaacggcccgggttgaattaacactcgatgattcccagcgtgtgagcgacaaaatcccgtttattgttgacttggcacccagtgggaaatactacatggcagacctttatgaaattggcgggattccatctgtgcagaagctgttgattgccgcaggcttgatggacggtgacatccccacagtaactggcaaaacgctagcagagaacatccaatccttcccctccctcccacaggaccaggccatcatccacccgctagccaaccccatcaagagcacgggccatatacaaatattgaaaggcaacctcgcccccggcggcgccgtagccaaaatcacaggcaaagaaggcaccaaattcaccggcaaagccctcgttttcaacaaagaacacgagcttgacgaagcgcttaacaagggcctaataccccgcggcgaaaacctagtgctaatagttcgctacgagggtccgaagggtggccccggcatgcccgagcagctgaaggccagcgcagcgctgatgggcgccaaactgacgaatgtcgcgctaattacggacgggaggtattcgggggccagtcatgggtttattgtcgggcatattgtgcctgaggcggcggttggggggcccattgctgttgtgcacaatggggatatgattacgattgatgcggagagaaatgagattagtatggcggtttcggaggaggaggttgcggagaggttgaaggagtggaggccgccgaagccgcatgtgactagggggacgttggccaagtatgcgagacttgttggagacgcgtcgcatggggctatgacggatatgttttga

SEQ ID NO: 482 - protein, 595 aa, Paracoccidioides brasiliensis
MNPEEKVDGFEEPRYIQFPCLPDDATRDGKPVLNKYSTFLTAMLYGAGVPDRESMKNSPQVGIATVWWEGNACNMHLLDLGKTVKKAITDQGMLGWQYNTIGVSDAISMGSEGMRYSLQSREIIADSIETVVGAQYHDAALRFRCDKNMPGCVMGMARHNRPSLMIYGGTIQVGYSKLLRRRINVSTCYEAAGAYAYNTLTQPDDGGDRSRTKDEIMEDIERNACPSAGACAGMYTANTLATAIESMGLTLPGSSSTPATVPAKMRECVKAADAIRICMEKNIRPRDLLTKRSFENALVITMALGGSTNSIVHLIAMARTARVELTLDDSQRVSDKIPFIVDLAPSGKYYMADLYEIGGIPSVQKLLIAAGLMDGDIPTVTGKTLAENIQSFPSLPQDQAIIHPLANPIKSTGHIQILKGNLAPGGAVAKITGKEGTKFTGKALVFNKEHELDEALNKGLIPRGENLVLIVRYEGPKGGPGMPEQLKASAALMGAKLTNVALITDGRYSGASHGFIVGHIVPEAAVGGPIAVVHNGDMITIDAERNEISMAVSEEEVAERLKEWRPPKPHVTRGTLAKYARLVGDASHGAMTDMF

SEQ ID NO: 483 - DNA, 1635 bp, Phaeosphaeria nodorum
atggatccgcgcaaccttgaaaagcagcgagagccagaggagccgcgcttcctcacgttcccgcatctgccagaggatgccatgcgagatggcaagcctgcgttgaacaaatactcgtctactcttactgctggccataactttccgggagctcaggccatgctttatgcggctggtgttccctcgaaggaagccatgaagacacagcctcacgtaggcattgcgagtgtatggtgggaaggcaacccatgcaaaactgcagtgctcgacctgggaaaggagattaagaaaaacgtccaggctgacaatatgctggcatggcagtacaacactgtgggcgtgtcggatggtattacgatgggtggagagggcatgcgcttctctctgcagactcgcgagataatagcagacagtattgagacggtcacgtgcgcgcaacatcacgacgcgtgtattgccattcccggatgcgacaagaatatgcctggtgtcatcatggcatttgcccgtcacaaccgaccatcgataatggtatatggcggctccataatgccaggctattccgagacgctcaagaagcccatcaacatttcaacatgctacgagaaacacggtgcctatatctacaagaatctggagagtgctgaaaaggggaaattttcgccagaggaaatcatggatgacattgagcgcaatgcatgcccgggtgctggcgcatgtggcggcatgtacactgccaacactatgtccacgtccattgaggccaagatgcgcgaatgtgccaaagctgcagctgccatccgcgtctgcatggaaaagaacatcacgccccggaaactactcaccaaggcctccttcgagaatgccctcgtcatgatgatggtcctcggcggctcgaccaacgccgtcctgcacatgctcgccatggccggtacagcaggcgtccccttaacccttgacgacttccagcgcgtgtccaacaaaattcccttcctcgccgacctcgccccctctggccgctacatggctgccgacctctttgacattggcggcatgccctccgtcatgaagctcctcgtcgccgcgggcctccttgacggtagcatccccaccgttaccggcaagaccctcgcagaaaacatcgagccctacccttccttgccgcaagatcaggtcctcatccgccccctctccaaccccatcaaagccaccggccacatcgagatcctacgcggcaacctcgcgcccgccggcgccgtggcgaaaatcacggggaaagagggcttgatattccgcggtagggcgatggtatttgacaaggaacaccagcttgacaaggcgctgaatgaaggtcgtattccgcatggcgagaatatcgtcgttgtcgtgcgctacgagggaccgaagggtggcccgggtatgcccgagcaactcaaagccagcgcggcgattatgggcgcgaaactcaccaacgtcgcgctaattacggatgggcggtatagtggtgccagtcacgggtttattgtcgggcacatgtgtccagaagcggccgtgggtggccccattgctgtggttagggatggggatgttatcactattggtaagtcgtgttgcaaagtcggagagagatggtga

SEQ ID NO: 484 - protein, 544 aa, Phaeosphaeria nodorum
MDPRNLEKQREPEEPRFLTFPHLPEDAMRDGKPALNKYSSTLTAGHNFPGAQAMLYAAGVPSKEAMKTQPHVGIASVWWEGNPCKTAVLDLGKEIKKNVQADNMLAWQYNTVGVSDGITMGGEGMRFSLQTREIIADSIETVTCAQHHDACIAIPGCDKNMPGVIMAFARHNRPSIMVYGGSIMPGYSETLKKPINISTCYEKHGAYIYKNLESAEKGKFSPEEIMDDIERNACPGAGACGGMYTANTMSTSIEAKMRECAKAAAAIRVCMEKNITPRKLLTKASFENALVMMMVLGGSTNAVLHMLAMAGTAGVPLTLDDFQRVSNKIPFLADLAPSGRYMAADLFDIGGMPSVMKLLVAAGLLDGSIPTVTGKTLAENIEPYPSLPQDQVLIRPLSNPIKATGHIEILRGNLAPAGAVAKITGKEGLIFRGRAMVFDKEHQLDKALNEGRIPHGENIVVVVRYEGPKGGPGMPEQLKASAAIMGAKLTNVALITDGRYSGASHGFIVGHMCPEAAVGGPIAVVRDGDVITIGKSCCKVGERW

SEQ ID NO: 485 - DNA, 1803 bp, Gibberella zeae
atggcggaccaagtcactcacgatcccaagcagtcaagcgactacatccccttcccttgccttcctcccggcggagctctcaaccgttggtctacaaagatcacccgcgagcatgactaccccggagctcaggctatgctctacggagctggtgtcaaggaccagcacacaatgaagaacgcgccccaggttggtgttgctaccgtctggtggcaaggaaacccgtgcaatacccatctccttgatcttggccagatcgtcaagaactccatcgagaaggaaggcatgatcggctggcagttcaacaccgttggtgtatctgacgccatcaccatgggcggcgagggcatgcgcttctctcttcaaactcgagaaatcattgctgattctatcgagtccgtaacctgcgcccagcatcatgacgccaacatctccattcccggctgtgacaagaacatgcccggcacagtcatggccgccgctcgtcacaaccgccccttcatcatgatctacggcggtaccatccgcaagggccactccaacctccttgagaagcccatcaacatcagcacctgctacgaggcctcgggtgctttcaactacggtcgtctgcatgccaagacgaaccccggcgagcctggtcgcgagagctccgatgtcatggatgatatcgagaagcacgcttgtcccggcgccggagcttgtggtggcatgtatacagccaacaccatggctaccgctatcgaggccatgggccttactctgcctggttcatcatcgtaccctgccgagtctcctgagaagcgtcgtgagtgtgagcgcgctgcccaggttatccgaactaccatggagaaggaccttcgtcctcgcgatatcatgacccgtgcctctttcgagaacgctcttgtcctgaccatgattctcggtggttcaacaaacggtgttcttcacttcctcgccatggccaacaccgccgatgttcccctgaccattgacgacatccagcgtgccagtgaccgcacccccttcctcgctgatctcgcccccagtggaaagtactacatggaggatctctacaaggtcggcggtacaccctccgtcatcaagatgctcgtcgcccgtggtcttctcgacggtagcatcatgaccattaccggcaagactctcgccgagaacgtcgcggactggcctagtctggaccccggccaggacatcatccgtcctcttgagaaccccatcaaggactctggccacatccgcatcctaaagggtaactttgcccccggcggcgccgtcgctaagatcactggaaaggagggtctgtccttcaccggcaaggcccgtgtcttcaacaccgagaaggagctcaacggcgcactgaaccgaagcgagatcaagcagtccgatggtaacctcgtcgtcatcgtccgatacgagggccccaagggcggtcccggtatgcctgaacagctcaaggcttctgcagccatcatgggtgccggcctctccaacctggcacttgtcaccgacggacgatacagtggtgcttctcacggtttcatcgtgggccacgttgtgcctgaggctatggtcggaggtcccatcgctctggtcaaggatggagacgagatcactatcgatgcgattaacaaccgaatcgatgtcgacatcactgacgaggagatggagaagcgaaggagtgagtggaagcctcctgcgccccgtgttacgaggggtgtgttggccaagtatgcccgcttggtcggtgatgcttcccacggtgctgtaacagatcagtggtag

SEQ ID NO: 486 - protein, 600 aa, Gibberella zeae
MADQVTHDPKQSSDYIPFPCLPPGGALNRWSTKITREHDYPGAQAMLYGAGVKDQHTMKNAPQVGVATVWWQGNPCNTHLLDLGQIVKNSIEKEGMIGWQFNTVGVSDAITMGGEGMRFSLQTREIIADSIESVTCAQHHDANISIPGCDKNMPGTVMAAARHNRPFIMIYGGTIRKGHSNLLEKPINISTCYEASGAFNYGRLHAKTNPGEPGRESSDVMDDIEKHACPGAGACGGMYTANTMATAIEAMGLTLPGSSSYPAESPEKRRECERAAQVIRTTMEKDLRPRDIMTRASFENALVLTMILGGSTNGVLHFLAMANTADVPLTIDDIQRASDRTPFLADLAPSGKYYMEDLYKVGGTPSVIKMLVARGLLDGSIMTITGKTLAENVADWPSLDPGQDIIRPLENPIKDSGHIRILKGNFAPGGAVAKITGKEGLSFTGKARVFNTEKELNGALNRSEIKQSDGNLVVIVRYEGPKGGPGMPEQLKASAAIMGAGLSNLALVTDGRYSGASHGFIVGHVVPEAMVGGPIALVKDGDEITIDAINNRIDVDITDEEMEKRRSEWKPPAPRVTRGVLAKYARLVGDASHGAVTDQW

SEQ ID NO: 487 - DNA, 1923 bp, Neurospora crassa
atggcttccaaccaagataataaggctgtcgctcccgacgccgccgctcccgccggccagtccaccaccaccacgaccaccaacgacaacagcgagcgcaacttgcccaaagagggcgaatacatccaatggcgtactctcccagctggcaaccccgaccagttgaaccgctggtcgcactttttgactcgtgagcatgagtttcctggagctcaggccatgctctacggcgccggtgtcccgaataaggacatgatgaagaaggcgccgcatgtcggcattgcgacggtctggtgggagggcaacccctgcaacacccatttgctggatcttggccaaaaggtcaagaaggccgttgagcgcgagaagatgcttgcgtggcagttcaacaccattggtgtctcggatggtatcaccatgggcggagagggcatgcgctactcgcttcagtctcgcgagatcatcgccgactccatcgagaccgtgacgtgcgctcagcatcatgacgccaacatctccattcccggctgcgacaagaacatgcccggtgtcatcatggccgcggcccgccacaaccgtcccttcgtcatgatctacggcggcaccatgcgcggcggccactcggagctcctcgaccgccccatcaacatcgtcacttgctacgaggcttccggcgcttacacgtatggccgtctcaagcccgcttgccccaacagcaccgccaccccttcggacgtcatggacgacatcgagcagcacgcctgccccggcgccggcgcctgcggcggcatgtacaccgccaacaccatggcgaccgccatcgaagccatgggcctcaccgcaccgggctcctcttctttccctgcctcttcgcccgaaaagttccgcgagtgcgaaaaagccgccgagtacatcaagatctgtatggagaaggacattcgcccgcgcgacctcttgaccaaggcctcgttcgagaacgccctcgtgctcaccatgatcctcggcggttctaccaatggcgttctgcactacctcgccatggccaactcggccgacgtcgacttgactctggacgacatcaaccgcgtctcagccaagacgccctttttggctgacatggccccctccggcaggtactacatggaagacctgtacaaagtcggcggcacccccgcggtcctcaagatgctcatcgccgcaggctatatcgatggcaccatccccactatcaccggcaagtctttggcggaaaacgtatccgactggcctagtctcgaccccgatcaaaaaatcatccgcccccttgacaaccccatcaagtcccaggggcatatccgtgtcttgtacggaaacttctcccccggtggtgcggtcgccaagattacaggcaaggaaggtctctccttcaccggcaaagcccgttgtttcaacaaggaattcgagctcgacgccgccttgaagaactcggaaattaccctcgagcaaggaaaccaggtcctcatcgtgcggtacgaaggacccaaaggcggtccaggtatgccagagcaactgaaggcttcagcggcgatcatgggcgcgggcctgacgaatgtcgcgctggtgacggatggtcggtactctggtgcgtcgcatgggtttattgtgggccatgtggtccccgaggcggcgacgggggggccgattgcgctggtgaaggacggggatttgattacgattgatgcggttaggaaccggattgatgtcgtcaagactgtggaaggcgtcgagggtgaggaagagattgccaaggtgttggaggagagaaagaaggggtggaaggcgccgaagatgaagccgacgaggggggcgttggccaagtatgcgaggttggtgggggatgcgtcgcatggggctgttactgatttgggtggggatgcctattag

SEQ ID NO: 488 - protein, 640 aa, Neurospora crassa
MASNQDNKAVAPDAAAPAGQSTTTTTTNDNSERNLPKEGEYIQWRTLPAGNPDQLNRWSHFLTREHEFPGAQAMLYGAGVPNKDMMKKAPHVGIATVWWEGNPCNTHLLDLGQKVKKAVEREKMLAWQFNTIGVSDGITMGGEGMRYSLQSREIIADSIETVTCAQHHDANISIPGCDKNMPGVIMAAARHNRPFVMIYGGTMRGGHSELLDRPINIVTCYEASGAYTYGRLKPACPNSTATPSDVMDDIEQHACPGAGACGGMYTANTMATAIEAMGLTAPGSSSFPASSPEKFRECEKAAEYIKICMEKDIRPRDLLTKASFENALVLTMILGGSTNGVLHYLAMANSADVDLTLDDINRVSAKTPFLADMAPSGRYYMEDLYKVGGTPAVLKMLIAAGYIDGTIPTITGKSLAENVSDWPSLDPDQKIIRPLDNPIKSQGHIRVLYGNFSPGGAVAKITGKEGLSFTGKARCFNKEFELDAALKNSEITLEQGNQVLIVRYEGPKGGPGMPEQLKASAAIMGAGLTNVALVTDGRYSGASHGFIVGHVVPEAATGGPIALVKDGDLITIDAVRNRIDVVKTVEGVEGEEEIAKVLEERKKGWKAPKMKPTRGALAKYARLVGDASHGAVTDLGGDAY

SEQ ID NO: 489 - DNA, 1575 bp, Coprinopsis cinerea
atggataaaccccagatcggtatttcgccggtctggtgggaaggcaatccatgcaatttccacctccttgaccttgcaaagcatgtcaagaaaggctgtcaagaagaagaccagattgggttgatctttaataccatcggtgtcagtgatgccattacgatgggtacagacggaatgcggtacagtctacccagtcgagacctcatcgcggactccatcgaagcagtcgtcatggcccagcactacgacggaaacatcgctattcctggatgcgacaagaacatgcccggctgcttcatggctgctgtccgacacaaccgaccgaccattatcgtctatggagggactatccaacctggtacccggcacgttggtgcctttactgtgggcaagatcaccgatgagcagaggttcgacgttgtgcgacatgcctgtcctggccccggagcctgcggcggaatgtacactgcgaacacgatgagttctgccctcgaggtcctcggcttgtcgctcccgtattcttcaagtatcccagcgatgcatccagagaaggtccaagaatgcttcagggctgccaagtacatgaagaagctgcttgagttggatttgaagcccagggatatcttgacgaagcagtccttcctgaatgccattgtcatcatcaccgttctgggaggctccacgaacgcggttctccacttgttggcaatggcccgagctgctgagattgatctcaccatcgacgacttccaagctgtagcagacaggacaccattcctggccgacctcatgccgtcaggtcgctattacatggaagacatccaccgcattggcggcatccccgccatcgtcaagtatttgttgaaccactccgatctcatcgacggaaaccagatgactgtcactggaaagacgctggctgagaacctagcggatgttcctgagcttgagttccataaccaggacgtcttccgtccactggacaatcctatcaagccgacaggtcatatcacgatcttgagaggtaacctggcgccagaaacagctgttgcgaagctcactggcaaagagggactgagattcgagggtgtcgcgcgttgcttcgatagcctcgagaagttctaccccgctcttgctgcaggggaaatcaaacccggaactgtcctaatcttcagatatcaaggtcccaaaggtgcacccggtatgccggagatgttgggtatgagcgctgcatcgcgtggtccaactggagctatcgcaggcgctggcttggccaactcgactgcgttgatcacggacggccgtttctctggcgccagccgagggtttattattgggcacgtcgtcccagaggcacgagttggcggacccattgcccttgtcaaggacggagacaagatcgtcatcgacgccgagactcgaacaatcaactggctcgtggatgaggaagaacaagcaaagaggaggaaagaatgggaggcgtcggataacggcaagttgaatgtgaagagaggagttttgtaccgatatgccagagatgtcgcgcctgcaagcatgggagcatattgtgattga

SEQ ID NO: 490 - protein, 524 aa, Coprinopsis cinerea
MDKPQIGISPVWWEGNPCNFHLLDLAKHVKKGCQEEDQIGLIFNTIGVSDAITMGTDGMRYSLPSRDLIADSIEAVVMAQHYDGNIAIPGCDKNMPGCFMAAVRHNRPTIIVYGGTIQPGTRHVGAFTVGKITDEQRFDVVRHACPGPGACGGMYTANTMSSALEVLGLSLPYSSSIPAMHPEKVQECFRAAKYMKKLLELDLKPRDILTKQSFLNAIVIITVLGGSTNAVLHLLAMARAAEIDLTIDDFQAVADRTPFLADLMPSGRYYMEDIHRIGGIPAIVKYLLNHSDLIDGNQMTVTGKTLAENLADVPELEFHNQDVFRPLDNPIKPTGHITILRGNLAPETAVAKLTGKEGLRFEGVARCFDSLEKFYPALAAGEIKPGTVLIFRYQGPKGAPGMPEMLGMSAASRGPTGAIAGAGLANSTALITDGRFSGASRGFIIGHVVPEARVGGPIALVKDGDKIVIDAETRTINWLVDEEEQAKRRKEWEASDNGKLNVKRGVLYRYARDVAPASMGAYCD

SEQ ID NO: 491 - DNA, 1767 bp, Laccaria bicolor
atgtcagctccgggagacgtttacattcacgatgtcctcaagaaatcgagcctccccgattcgaagttgaacaggatatcctgtcaattaacgcaaaacaagattcggggtggcgctcaggcgatgctttacgctgtcggtttgagtgaggacgatatgaacaagcctcagattgggatttctccagtgtggtgggaagggaacccatgtaactctcaccttcttgaccttgccaagcacgtaaaggaaggttgtaaagcagaggatcttgttggtcttatcttcaataccattggcgtcagcgacgcgattacgatgggaacagatggaatgagatattctctgccaagtcgagatatcattgcagattcaatcgaagctgctcaacattacgacgccaacatctcaataccagggtgtgacaagaacatgccaggttgcttcatcgccgcagtccgtcataatcgaccaacgatcattgtttacggtggaactattcaaccgggcgtccggcatgtcgattgcccttcgatgggcaaggaaaaaggtggatcagtgaatatctctgacgcatttgaatcttatggggcattcgccgttggaaaaattaacgacgtggagcgatttgatgtcgttcgccacgcatgtcctggcgcaggggcttgtggaggcatgtacactgcgaacaccatgagttcagcccttgaggctcttgggatatctttgccctattcatcgagcacgccagccctgtaccccgagaaggttcaagagtgttttcgagcagcaaagtatttaaaacgtttgcttgaattagatctgaagcccaaggacattttgacccgaaactcgtttttaaatgctatcgtcatcataaccgttctcggtggctccacgaatgcagttttgcacttgctagctatggctcgcgcagctgaggtagaactcacaatcgatgacttccaaatgattgcagacaaaacgcctttcctggccgatttaatgccttcagggaggtattatatggaggatatccacaagatcggaggaatccctgccattctgaaatacctattgaaccacaccgatcttatcgatgggacacagatgacggtgaccgggcgtactttggcagaaaacctcgcagatgtacctgagctcgagttcgataagcaagatgttgttcgaagcttgagcaatcctatcaagaaaacgggccatatcacgatcatgcggggaaatctagctccagagacggccgtagccaaactcacagggaaagaaggtctcaaatttgagggaattgcgagatgctttgatagcttggatggattctatccagcgcttgaggcgggtgagatcaaggcaggcacggtgcttatctttaggtatcaaggaccaaaaggtgcacccggtatgcccgagatgcttggtccaacaggagccattgcaggcgctggacttgctcgttccacagccttaataacagatggtcgcttctcaggagccagtcgaggatttatcataggtcacgtcgtgccggaagcccgtgttggaggacctatcgcactcgttaagaatggggaccgaatcgtcattgattccgagacccgaacgatcaactggctggttgatgagaacgaacaaaaactgcgcaaggcagaatgggatgcctcagagaattcgaaattcaatgtcgggcggggtgtacttttgaggtacgctcgagatgtcgcaccggccaaccttggagcatattgcgattga

SEQ ID NO: 492 - protein, 588 aa, Laccaria bicolor
MSAPGDVYIHDVLKKSSLPDSKLNRISCQLTQNKIRGGAQAMLYAVGLSEDDMNKPQIGISPVWWEGNPCNSHLLDLAKHVKEGCKAEDLVGLIFNTIGVSDAITMGTDGMRYSLPSRDIIADSIEAAQHYDANISIPGCDKNMPGCFIAAVRHNRPTIIVYGGTIQPGVRHVDCPSMGKEKGGSVNISDAFESYGAFAVGKINDVERFDVVRHACPGAGACGGMYTANTMSSALEALGISLPYSSSTPALYPEKVQECFRAAKYLKRLLELDLKPKDILTRNSFLNAIVIITVLGGSTNAVLHLLAMARAAEVELTIDDFQMIADKTPFLADLMPSGRYYMEDIHKIGGIPAILKYLLNHTDLIDGTQMTVTGRTLAENLADVPELEFDKQDVVRSLSNPIKKTGHITIMRGNLAPETAVAKLTGKEGLKFEGIARCFDSLDGFYPALEAGEIKAGTVLIFRYQGPKGAPGMPEMLGPTGAIAGAGLARSTALITDGRFSGASRGFIIGHVVPEARVGGPIALVKNGDRIVIDSETRTINWLVDENEQKLRKAEWDASENSKFNVGRGVLLRYARDVAPANLGAYCD

SEQ ID NO: 493 - DNA, 1794 bp, Ustilago maydis
atggtcaacggagaagtcgagctgcgcacaacttcgcgcaccaatggtgacgctcccgccccgatcctgaacaggatcagtcgatacatcacgcaatcctccgacaagggagctgctcaatccatgcttcacgcgtgcggtctttcggtacaagacctcgacaagccccaggttggcatctcatctgtatggtgggaaggcaacccatgcaatactcacctgctcgaatttggccgcaagatcaagcaaggctgcgaagcggaaggtctggtgggcttgcaaaataacacggtgggcgtttccgatgccatcaccatgggcggccccggaatgcagtattcgcttccttcgagagagctgatcgccgactctatcgagacgatcaccctcgcgcagtatcatgacgctaatgtgtccatccccggttgtgacaagaacatgcctggctgtctcattgcttgtctgcgtcacaaccgcccatcaatcatcgtttatggcggcacgatccaacccggcaagcacggaatggacatacccgctcttggaaggaagaagggcgacccatgcaatgtcgccgacaatttcgaagcgacaggagcttacgccaagggcctcatcacggcagaagagcgtgtcgacctgatccgcaacgcctgtcccggtcctggtgcttgcggaggcatgtacaccgccaacaccttgtctatcgcgatcgaagtcatggggatgggtctcccgttgaccagcagtactcccgctgtctaccctgaaaagatgcaagaatgtctgcgtgttggagcctacatcaagaatctgctagccaaggatatcaagcctcgcgacatcatgaccaagaaggcttttgagaatgctatcgtgatgactcatgttcttggtggctcgactaatgctgttctccatctcatcgctgttgcacgtgctggcgatatcgacattaccatcgacgacttccaaaggctcggcgacaagacacccatgttggccgacgtcaagccatcgggcaagtattacatggaagacattcacaagatcggaggtgttcctcgtgtgctcaagtacattctggagaacacggatctgcttcatggtgacgtgatgacggtgacgggtaaaacgatgcgcgagaatctcgtcgatgttgaaccactggagtttgagacgcaagatatcatccgacctctcagcaaccctatcaaggcaacgggccacctgaccatcatgcgtggatcgctgtgccccggcggagctgtgtccaagctgacgggcaaagaggggctgtactttgacggcagcgctgttgtctttgactctgaagacggcatcaccgaagcaatcgcagaaggccgtgtcaaagaaggcagcgttgtcgtcattcgctatgttggaccaaaaggtggtcctggtatgcccgagatgctcggaccaaccggtgcgatcatgggcgcaggtctcggaaaaacagtagcgctcatcaccgacggtcgtttctctggcgcttcgcacggattttgcacaggacatgttgtgccagaagcagccctgggaggaccgatcgcgctcgtacaagacggagacaggatcactgtcgatgccaacacgcgcgagatcaacttgcacatcagtgacgaagagatggagaagaggaaacagtggtggctcaaagagaaaaagcctactctgacaaagaaacacaagcgcggttggctgtacaagtttgcaagggatgtacaaaacgcttccgagggttgtgttactgatcgcgatctgttttga

SEQ ID NO: 494 - protein, 597 aa, Ustilago maydis
MVNGEVELRTTSRTNGDAPAPILNRISRYITQSSDKGAAQSMLHACGLSVQDLDKPQVGISSVWWEGNPCNTHLLEFGRKIKQGCEAEGLVGLQNNTVGVSDAITMGGPGMQYSLPSRELIADSIETITLAQYHDANVSIPGCDKNMPGCLIACLRHNRPSIIVYGGTIQPGKHGMDIPALGRKKGDPCNVADNFEATGAYAKGLITAEERVDLIRNACPGPGACGGMYTANTLSIAIEVMGMGLPLTSSTPAVYPEKMQECLRVGAYIKNLLAKDIKPRDIMTKKAFENAIVMTHVLGGSTNAVLHLIAVARAGDIDITIDDFQRLGDKTPMLADVKPSGKYYMEDIHKIGGVPRVLKYILENTDLLHGDVMTVTGKTMRENLVDVEPLEFETQDIIRPLSNPIKATGHLTIMRGSLCPGGAVSKLTGKEGLYFDGSAVVFDSEDGITEAIAEGRVKEGSVVVIRYVGPKGGPGMPEMLGPTGAIMGAGLGKTVALITDGRFSGASHGFCTGHVVPEAALGGPIALVQDGDRITVDANTREINLHISDEEMEKRKQWWLKEKKPTLTKKHKRGWLYKFARDVQNASEGCVTDRDLF

SEQ ID NO: 495 - DNA, 1851 bp, Escherichia coli
atgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaa

SEQ ID NO: 496 - protein, 616 aa, Escherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 497 - DNA, 1677 bp, Bacillus subtilis
atggcagaattacgcagtaatatgatcacacaaggaatcgatagagctccgcaccgcagtttgcttcgtgcagcaggggtaaaagaagaggatttcggcaagccgtttattgcggtgtgtaattcatacattgatatcgttcccggtcatgttcacttgcaggagtttgggaaaatcgtaaaagaagcaatcagagaagcagggggcgttccgtttgaatttaataccattggggtagatgatggcatcgcaatggggcatatcggtatgagatattcgctgccaagccgtgaaattatcgcagactctgtggaaacggttgtatccgcacactggtttgacggaatggtctgtattccgaactgcgacaaaatcacaccgggaatgcttatggcggcaatgcgcatcaacattccgacgatttttgtcagcggcggaccgatggcggcaggaagaacaagttacgggcgaaaaatctccctttcctcagtattcgaaggggtaggcgcctaccaagcagggaaaatcaacgaaaacgagcttcaagaactagagcagttcggatgcccaacgtgcgggtcttgctcaggcatgtttacggcgaactcaatgaactgtctgtcagaagcacttggtcttgctttgccgggtaatggaaccattctggcaacatctccggaacgcaaagagtttgtgagaaaatcggctgcgcaattaatggaaacgattcgcaaagatatcaaaccgcgtgatattgttacagtaaaagcgattgataacgcgtttgcactcgatatggcgctcggaggttctacaaataccgttcttcatacccttgcccttgcaaacgaagccggcgttgaatactctttagaacgcattaacgaagtcgctgagcgcgtgccgcacttggctaagctggcgcctgcatcggatgtgtttattgaagatcttcacgaagcgggcggcgtttcagcggctctgaatgagctttcgaagaaagaaggagcgcttcatttagatgcgctgactgttacaggaaaaactcttggagaaaccattgccggacatgaagtaaaggattatgacgtcattcacccgctggatcaaccattcactgaaaagggaggccttgctgttttattcggtaatctagctccggacggcgctatcattaaaacaggcggcgtacagaatgggattacaagacacgaagggccggctgtcgtattcgattctcaggacgaggcgcttgacggcattatcaaccgaaaagtaaaagaaggcgacgttgtcatcatcagatacgaagggccaaaaggcggacctggcatgccggaaatgctggcgccaacatcccaaatcgttggaatgggactcgggccaaaagtggcattgattacggacggacgtttttccggagcctcccgtggcctctcaatcggccacgtatcacctgaggccgctgagggcgggccgcttgcctttgttgaaaacggagaccatattatcgttgatattgaaaaacgcatcttggatgtacaagtgccagaagaagagtgggaaaaacgaaaagcgaactggaaaggttttgaaccgaaagtgaaaaccggctacctggcacgttattctaaacttgtgacaagtgccaacaccggcggtattatgaaaatctag

SEQ ID NO: 498 - protein, 558 aa, Bacillus subtilis
MAELRSNMITQGIDRAPHRSLLRAAGVKEEDFGKPFIAVCNSYIDIVPGHVHLQEFGKIVKEAIREAGGVPFEFNTIGVDDGIAMGHIGMRYSLPSREIIADSVETVVSAHWFDGMVCIPNCDKITPGMLMAAMRINIPTIFVSGGPMAAGRTSYGRKISLSSVFEGVGAYQAGKINENELQELEQFGCPTCGSCSGMFTANSMNCLSEALGLALPGNGTILATSPERKEFVRKSAAQLMETIRKDIKPRDIVTVKAIDNAFALDMALGGSTNTVLHTLALANEAGVEYSLERINEVAERVPHLAKLAPASDVFIEDLHEAGGVSAALNELSKKEGALHLDALTVTGKTLGETIAGHEVKDYDVIHPLDQPFTEKGGLAVLFGNLAPDGAIIKTGGVQNGITRHEGPAVVFDSQDEALDGIINRKVKEGDVVIIRYEGPKGGPGMPEMLAPTSQIVGMGLGPKVALITDGRFSGASRGLSIGHVSPEAAEGGPLAFVENGDHIIVDIEKRILDVQVPEEEWEKRKANWKGFEPKVKTGYLARYSKLVTSANTGGIMKI

SEQ ID NO: 499 - DNA, 1836 bp, Agrobacterium tumefaciens
atgccagcctatcgctccagaacgacaacccacggccgcaacatggcgggcgcgcgcggcctttggcgcgccaccggcatgaaggacagcgatttcggcaagccgatcatcgcggtggtcaattccttcacgcagttcgtaccgggccatgtgcatctaaaggatctcggccagctcgttgcccgcgaaatcgaggcggccggcggcgttgccaaggaattcaacacgattgcggtcgatgatggtatcgccatgggccatgacggcatgctctattcgctgccgtcgcgcgagatcatcgctgactcggtcgaatatatggtcaatgcccattgcgccgatgcgatggtctgcatttccaactgcgacaagatcacgcccggcatgctgaatgccgcgatgcgcctcaacattcccgccgttttcgtgtccggtggtccaatggaagcgggcaaggtggttctgcacggcaagaccgttgcgctcgatctggtcgacgcgatggtggctgctgccgacgacaagatttccgatgaggacgtcaagatcatcgagcgctccgcctgcccgacctgcggttcctgttccggcatgttcacggccaattccatgaactgtctgaccgaggcgctcggcctgtcattgcccggcaacggctcgacgcttgccacccactccgatcgcaagcgcctgttcgttgaagccggtcacctgatcgtcgatctggcccgccgttattacgagcaggacgacgaaaccgttctgccgcgcaccatcgccaacaaggcggcgttcgaaaacgccatgtcgctggatattgccatgggcggctccaccaacacggttctgcatattctggcggcagcccacgagggcggcgtcgatttcggtatggaggacatcgaccggctttcccgcaaggttccctgcctttccaaggttgcgcctgcgaagcaggatgtgcacatggaagacgtgcatcgcgccggcggcatcatgcgtattctcggtgagctggagcgtggcggtctcatcaaccgcgatacctataccgtacacgaagcgacgcttggcgatgccatcgaccgctgggacatcacgcgcaccaacagcgaaatggtgcggcagttcttcaaggccgctccgggcggcgtaccgacacaggtggccttcagccagtcctcgcgctgggatgatctggacaccgacagcgacaacggcgtcattcgttcggtcgagaagcctttctccaaggatggcggtctggccgttctttacggcaacatcgcgctcgatggctgcatcgtgaagacggcgggtgttgatgaatccatcctgaaattcaacggatcggcagtcgtttacgaaagccaggacgcggccgtgaagggcattctcggcaacgaggtcaaggcgggcgacgtcgtcgtcatccgctatgaaggaccgaagggcggcccgggcatgcaggaaatgctctatccgaccagctacctcaagtccaagggcctcggtaaagcctgcgcgctcatcaccgatggtcgcttctccggtggcacgtcaggcctttccatcggtcatgcctcgccggaagcggcgcagggcggtgccatcggcctcgtgcgtcagggcgacctgattgagatcgatattccgaaccgcacgatcaatctcaaggtttcggatgcggaactggccgcgcgccgggccgagcaggaagaaaagggctggaagccggaagcaccgcgcaagcgtaatgtcacgacggcgctcaaggcctatgcggcctttgcgtcgagcgcggacaagggtgctgtgcggattctgccggagtaa

SEQ ID NO: 500 - protein, 611 aa, Agrobacterium tumefaciens
MPAYRSRTTTHGRNMAGARGLWRATGMKDSDFGKPIIAVVNSFTQFVPGHVHLKDLGQLVAREIEAAGGVAKEFNTIAVDDGIAMGHDGMLYSLPSREIIADSVEYMVNAHCADAMVCISNCDKITPGMLNAAMRLNIPAVFVSGGPMEAGKVVLHGKTVALDLVDAMVAAADDKISDEDVKIIERSACPTCGSCSGMFTANSMNCLTEALGLSLPGNGSTLATHSDRKRLFVEAGHLIVDLARRYYEQDDETVLPRTIANKAAFENAMSLDIAMGGSTNTVLHILAAAHEGGVDFGMEDIDRLSRKVPCLSKVAPAKQDVHMEDVHRAGGIMRILGELERGGLINRDTYTVHEATLGDAIDRWDITRTNSEMVRQFFKAAPGGVPTQVAFSQSSRWDDLDTDSDNGVIRSVEKPFSKDGGLAVLYGNIALDGCIVKTAGVDESILKFNGSAVVYESQDAAVKGILGNEVKAGDVVVIRYEGPKGGPGMQEMLYPTSYLKSKGLGKACALITDGRFSGGTSGLSIGHASPEAAQGGAIGLVRQGDLIEIDIPNRTINLKVSDAELAARRAEQEEKGWKPEAPRKRNVTTALKAYAAFASSADKGAVRILPE

SEQ ID NO: 501 - DNA, 1902 bp, Burkholderia cenocepacia
gtgcctccacccttttcccgcgatatttcttcagccatcaccatgcccacttaccgttccaaaacctccaccgccggccgcaacatggcaggtgcgcgctcgctgtggcgcgccaccggcatgaaagacgacgatttctcgaaaccgatcatcgcggtcgtcaactcgttcacgcaattcgtgcccgggcacgtgcacctgaaggatctcggccagctcgtcgcgcgcgagatcgaggctgccggcggcgtcgcgaaggaattcaacacgatcgcggtcgacgacggcatcgcgatgggccacgacggcatgctgtactcgctgccgagccgcgacatcatcgccgactcggtcgaatacatggtgaacgcgcactgcgcggacgcgatggtgtgcatctcgaactgcgacaagatcacgccggggatgctgatggccgcgatgcgcctgaacattccggtgatcttcgtgtcgggcggcccgatggaagccggcaagacgcgcctcgcgaacccggtcaccaagaccgtcgaactgaagaagctcgacctcgtcgacgcgatggtgatcgcggccgaccagtcgtattcggacgccgacgtcgccgaagtcgaacgctcggcctgcccgacctgcggctcgtgctcgggcatgttcaccgcgaactcgatgaactgcctgaccgaagcgctcggcctgtcgctgcccggcaacggtacggtggtcgccacgcacgccgatcgcgaacagctgttcaagcgcgccggccgccgcatcgtcgaactgacgcgccagcactacgagcaggacgacgaacgcgtgctgccgcgctcggtcggcttcaaggcgttcgagaacgcgatgacgctcgacatcgcgatgggcggctcgaccaacacgatcctgcacctgctcgcgatcgcgcaggaagccggcatcgacttcacgatgaaggacatcgaccgcctgtcgcgcaccgtgccgcagctgtgcaaggtcgcgccgaacacgaacaagtaccacatcgaggacgtgcaccgcgccggcggcatcatggcgatcctcggcgagctcgagcgcgccggcaagctgcacaccgacgtgccgaccgtccatgcgccgacgctgaaggatgcgctcgaccagtgggacatcgtcctcacgcaggacgaagcggtccgcaggttctacctggccggcccggccggcatcccgacgcaggtcgcgttcagccagaacacgcgctggccgagcctcgacctcgaccgcgccgaaggctgcatccgctcgtacgagcatgcgttctcgaaggaaggcggcctcgcggtgctgacgggcaacatcgcgctcgacggctgcgtggtgaagacggccggcgtcgacgaaagcatcctcgttttcgaaggctcggcgcacgtgaccgaatcgcaggacgaagcggtcgagaacatcctcaacgacaaggtcaaggccggcgacgtggtgatcgtgcgctacgaaggcccgaagggcggcccgggcatgcaggaaatgctctacccgaccagctacatcaagtcgaaagggctcggcaaggcgtgtgcgctgctgacggacggccggttctcgggtggtacgtcggggctgtcgatcggccattgctcgccggaagcggcggcaggcggcgcgatcggcctcgtgcgcgacggcgaccggatccgcatcgacattccgaaccgcacgatcgacgtgctggtgtcggacgaggaactggcgcgccgccgcgaggagcagaacgcgaagggctggaagcctgcgcagccgcgtccgcgcaaggtgtccgcggcgctcaaggcgtacgcgaagctcgtcatgtcggccgacaagggcgccgtgcgcgatctgtcgctgctcgacgactga

SEQ ID NO: 502 - protein, 633 aa, Burkholderia cenocepacia
MPPPFSRDISSAITMPTYRSKTSTAGRNMAGARSLWRATGMKDDDFSKPIIAVVNSFTQFVPGHVHLKDLGQLVAREIEAAGGVAKEFNTIAVDDGIAMGHDGMLYSLPSRDIIADSVEYMVNAHCADAMVCISNCDKITPGMLMAAMRLNIPVIFVSGGPMEAGKTRLANPVTKTVELKKLDLVDAMVIAADQSYSDADVAEVERSACPTCGSCSGMFTANSMNCLTEALGLSLPGNGTVVATHADREQLFKRAGRRIVELTRQHYEQDDERVLPRSVGFKAFENAMTLDIAMGGSTNTILHLLAIAQEAGIDFTMKDIDRLSRTVPQLCKVAPNTNKYHIEDVHRAGGIMAILGELERAGKLHTDVPTVHAPTLKDALDQWDIVLTQDEAVRRFYLAGPAGIPTQVAFSQNTRWPSLDLDRAEGCIRSYEHAFSKEGGLAVLTGNIALDGCVVKTAGVDESILVFEGSAHVTESQDEAVENILNDKVKAGDVVIVRYEGPKGGPGMQEMLYPTSYIKSKGLGKACALLTDGRFSGGTSGLSIGHCSPEAAAGGAIGLVRDGDRIRIDIPNRTIDVLVSDEELARRREEQNAKGWKPAQPRPRKVSAALKAYAKLVMSADKGAVRDLSLLDD

SEQ ID NO: 503 - DNA, 1911 bp, Psychrobacter cryohalolentis
atggattacaattcaaaaacctctaccggcggtcgtaatatggcaggtgctcgtgccctgtggcgcgcaactggcatgactgatggcgactttggcaaacctattattgcaattgccaactcttttacccagtttgtacccggccatgtgcatttaaaagatttgggacaaatggttgcacgcgagattgaaaaagcgggtggcgtggcaaaagaatttaataccattgctgttgatgatggtattgccatgggtcatagcggcatgttgtattcactaccgagtcgagatttgattgctgattctgtcgagtatatggtcaatgcccactgcgccgatgcgctagtatgtatttctaactgcgataaaatcactccgggtatgttgatggcagccatgcgcctcaatatccccgtcgtctttatttcaggtggcccaatggaagcgggtaaaattatcgccagcacggtcgcacacagtcataataatgatggtagtagcgacgtccatagcactgacagtaaaggtaatgccattcgtaagcttgacctcgttgatgcgatgatggacgcggccgatgatagcattagtgatgaagatgtcgctgctattgaggcctcagcgtgcccgacttgtgggtcgtgctctggcatgttcactgccaactcgatgaattgcttgaccgaagcattaggattggcattaccgggtaatggctcgctattggcaacccattcgctacgtcgcgagctattcctagaagcgggtcgtactatcgtgtcactagccaaacgtcgctacgagcaagatgatgattcagtcctaccgcgctctatcgctactaaagccgcgtttgaaaatgccatgactttagacatcgccatgggcggctctaccaatactattttgcatttgcttgctgctgcacatgaagccgaagtcgacttcaaaatgcacgatattgaccgtttaagtcgtggcgtcccttgtttggctaaagttgcccctgcttcacaaaagtatcatatggaagatgtgcatcgtgctggtggtgtctttgcgctattggccgagcttgaccgtgctggtttgctgcataccgatttgccaactatccatagtgccacgatgaaagaagcgattgataaatgggatattatgaatcctgacaatcttgaagcacgtgcacgctatattgcagcccctggtggcgtacggacgactgaggctttctcacaatcaaaagaatggtcaaatctggatgtgaaccgagagtcaggctgtatccgaagtgcccaacatgcttattcaactgatggcggtcttgccgttctatacggaaacattgctgagcgtggctgtgtggtcaaaactgccggcgttgatgacagcatcttggttttcaccggacgtgcacgcatctttgaatcacaagatgatgcagtagcagcggtgcttgatgatcaaatcgtcgcaggcgatgtagttatcatccgttttgagggtccaaaaggcggtcctggtatgcaagagatgctctacccgacgacttatctaaaatctaaaggcctaggcaaagaatgtgcgctgcttacagatggtcgcttctctggtgggacatcaggcttgtctattggtcatgccagcccagaagccgctgaaggcggcgccattggcctagtgcaagaaggcgatactatccatattgatatcccaaaccgtaccatcaatatgcaggtcagtgatgaagagttagctgctcgccgcgaagaaatggaaagtcgtggacgtgatgcttggaaacccgttagccgtgagcgtcatgtctctcctgctttacgtgcctatgctgcaatgaccaccagtgccgatacgggcgctgtacgtgacgtcagccaagttgaacgttag

SEQ ID NO: 504 - protein, 636 aa, Psychrobacter cryohalolentis
MDYNSKTSTGGRNMAGARALWRATGMTDGDFGKPIIAIANSFTQFVPGHVHLKDLGQMVAREIEKAGGVAKEFNTIAVDDGIAMGHSGMLYSLPSRDLIADSVEYMVNAHCADALVCISNCDKITPGMLMAAMRLNIPVVFISGGPMEAGKIIASTVAHSHNNDGSSDVHSTDSKGNAIRKLDLVDAMMDAADDSISDEDVAAIEASACPTCGSCSGMFTANSMNCLTEALGLALPGNGSLLATHSLRRELFLEAGRTIVSLAKRRYEQDDDSVLPRSIATKAAFENAMTLDIAMGGSTNTILHLLAAAHEAEVDFKMHDIDRLSRGVPCLAKVAPASQKYHMEDVHRAGGVFALLAELDRAGLLHTDLPTIHSATMKEAIDKWDIMNPDNLEARARYIAAPGGVRTTEAFSQSKEWSNLDVNRESGCIRSAQHAYSTDGGLAVLYGNIAERGCVVKTAGVDDSILVFTGRARIFESQDDAVAAVLDDQIVAGDVVIIRFEGPKGGPGMQEMLYPTTYLKSKGLGKECALLTDGRFSGGTSGLSIGHASPEAAEGGAIGLVQEGDTIHIDIPNRTINMQVSDEELAARREEMESRGRDAWKPVSRERHVSPALRAYAAMTTSADTGAVRDVSQVER

SEQ ID NO: 505 - DNA, 1851 bp, Psychromonas sp.
atgcccaaattacgttcagcaactagtacagaaggccgaaacatggcaggcgcgcgtgcattgtggcgcgccactggcgtcaaagataatgattttggaaaacctattattgccattgcgaattcatttacccaatttgttcctgggcatgtacatcttaaaaacatgggtgatttagtggcgggtgcgattgctgaggcgggcggtatctctaaagaatttaataccattgcggttgatgacggcattgcgatgggccattcaggtatgctttatagtttaccttcacgtgacctgattgctgatagtgttgaatatatggtaaatgcacattgtgcggatgctttagtgtgtatttcaaattgtgacaagatcacgccggggatgttgatggcggcattacgccttaatattccggttgtttttgtctcaggtggcccgatggaagcgggtaaaaccaagctttcagataaaattattaagttagatttggtcgatgccatggtggcgggcgcagacgacaggatctccgacgctgacagtgcacaaattgagcgcagtgcttgcccaacgtgtggctcttgctctggtatgtttaccgctaactccatgaactgtctaacggaagtcttagggttatcactacccggtaatggcactatgcttgcaacgcacgcagacagacgcgctcttttcttagaagcgggaaagtgcattgtggcattaacgaaacgttattatgacgatgacgatgagtctgttttaccgcgtaatattgccaattttaaagcctttgaaaacgccatgacacttgatattgcgatgggaggctcaagtaatacggtgctgcatttattagctgctgcccaagaagcgcatattgattttaacatggatgatattgatagaatttcacgcttagtgcctcatttgtgcaaagttgccccctctacacctaaatatcatatggaagatgtgcaccgcgcaggtggggtaatgggtattttaggcgaattggacagagccggccttattcataatgacgctaatcatgtggcgggcagtagtttaaaagcggtattagagaaatgggatattgtgcaaactaaagaggcgagtgtgcgtgatttttaccgcgcaggtccgggaggtattccaactcagcaagcttttagtcaggatagtcgctgggatagtgtggatgatgacaggcagaatggctgtattcgtaaacgtgaatttgcgtttagccaagaaggcggacttgccgtgctggcgggtaatattgcgccaaagggctgtattgttaaaacggcgggggtcgatgaagaagagcatcaatttaccggtacggcgcgcgtgtttgagagccaagatgatgcagtgagcgccatcttagcgggaaaagtgattgcgggtgatgtggttgtcattcgttatgaaggccccaaaggtggccccggcatgcaagaaatgttgtatcccaccagttatttaaaatcacgtgggttaggtaaatcatgtgccttaataaccgacggacgattttcgggtggaacctcgggcttatcgattgggcatatttctccagaggctgcagcgggcggtaatattgccttgattgagacgggtgatgttatcaaaattgatattcctgcacgcagtattcaccttgatattagtgatgaagagctcaagttacgccataaaaatatgctagcgcgcggtaaacttgcttggaaacccgtttcgagaaaacgtattgtgccactcgcgcttaaagcttacgctttgctggtgaccagtgcagataaaggggcggttcgtgacgcttcaatgttggaggattaa

SEQ ID NO: 506 - protein, 616 aa, Psychromonas sp.
MPKLRSATSTEGRNMAGARALWRATGVKDNDFGKPIIAIANSFTQFVPGHVHLKNMGDLVAGAIAEAGGISKEFNTIAVDDGIAMGHSGMLYSLPSRDLIADSVEYMVNAHCADALVCISNCDKITPGMLMAALRLNIPVVFVSGGPMEAGKTKLSDKIIKLDLVDAMVAGADDRISDADSAQIERSACPTCGSCSGMFTANSMNCLTEVLGLSLPGNGTMLATHADRRALFLEAGKCIVALTKRYYDDDDESVLPRNIANFKAFENAMTLDIAMGGSSNTVLHLLAAAQEAHIDFNMDDIDRISRLVPHLCKVAPSTPKYHMEDVHRAGGVMGILGELDRAGLIHNDANHVAGSSLKAVLEKWDIVQTKEASVRDFYRAGPGGIPTQQAFSQDSRWDSVDDDRQNGCIRKREFAFSQEGGLAVLAGNIAPKGCIVKTAGVDEEEHQFTGTARVFESQDDAVSAILAGKVIAGDVVVIRYEGPKGGPGMQEMLYPTSYLKSRGLGKSCALITDGRFSGGTSGLSIGHISPEAAAGGNIALIETGDVIKIDIPARSIHLDISDEELKLRHKNMLARGKLAWKPVSRKRIVPLALKAYALLVTSADKGAVRDASMLED

SEQ ID NO: 507 - DNA, 1824 bp, Deinococcus radiodurans
atgccgacttaccgttccagaaccaccaccgagggccgtaatatggccggcgcccgtgccctgtggcgcgccaccggcatgaccgacggcgatttccagaagccgatcatcgcggtggtcaactcgttcacccagttcgtgccggggcacgtgcacctcaaggacctcgggcaactcgtcgcgggtgaaatcgcggcggcgggcggcgtggcgaaggagttcaacaccatcgccgtggacgacggcatcgccatgggccacgacgggatgctctactcactgcccagccgcgaaatcatcgccgacagcgtggagtacatggtcaacgcccactgcgccgacgcgatggtttgcatctccaactgcgacaagattacccccggcatgctgatggccgcgctgcgcctcaatatccccaccgtgttcgtctcgggcgggccgatggaagcgggcaaggtcaagctcggtgacggcgagcacgcgctggacctggtggacgcaatggtgatggccgccgacgacagcgtgagcgaggaagacatcgaactggtggagcgctcggcctgccccacctgcggctcgtgctcgggcatgttcaccgccaactcgatgaactgcctgacggaggcgctgggcctctcgctgccgggcaacggctcggtgctggcgacccactccgaccgccagaacctgttcaagcgcgccgggcacctgatcgtggacctcgccaagcgctactacgagggcgatgacgagagcgtgctgccgcgcagtgtcgccacctacgacgccttcgagaacgccatgaccctcgacatctcgatgggcggctcgaccaatacggtgctgcacctgctggccgccgcgcacgaggccggggtggatttcaccatgcaggacatcgaccagctctcgcggcgggtgccggtgctgtgcaaggtggcgcccgccaagaacgacgtgcacatggaagacgtgcaccgcgctgggggcatcatgggcattctgggcgagcttgaccgcgccgggctgctgaagaccgacgtgagcaccgtacacgcccccagcatgagcgccgccctgaacgagtgggacgtggtccgcaatgagaaccaccacgagttctaccgcgccgcgcccggcggcattcccaccgtcttcgccttctcgcagtcgcgccgttaccgcgaactcgacaccgaccgggaagcaggcgtcattcgcagcgccgagcacgctttctcgcaggacggcgggctggcggtgctgtacggcaacctcgccgaagacggctgcatcgtcaagacggcgggcgtggacgaatccatcctgaagttcagcggcccggcgcgcgttttcgagtcgcaagacgcctcggtggacgccatcctcagcggcgaagtcaaggaaggcgaggtcgtgctgattcgctacgaaggcccacgcggtggccccggcatgcaggaaatgctctacccgacgagctacctcaagtccaaggggctgggcaaagcctgcgcgctggtcaccgacggtcgtttctcgggcggcagcagcggcctgagcatcggccacgtctcgcccgaggcggcggagggcggcaccatcggcctggtcgagacgggcgacctcatcgaaatcgacatcccgaaccgcaccattcacctcgccgtgccggacgctgaactcgccgcccgccgccagaagcgcgaggaagaaggctggcaccccgccgaaccccggccccgcaaaatcaccgctgccctacgcgcctatgcgtctatgacgacgagcgcttcgcggggcgcggtgcggaatatctga

SEQ ID NO: 508 - protein, 607 aa, Deinococcus radiodurans
MPTYRSRTTTEGRNMAGARALWRATGMTDGDFQKPIIAVVNSFTQFVPGHVHLKDLGQLVAGEIAAAGGVAKEFNTIAVDDGIAMGHDGMLYSLPSREIIADSVEYMVNAHCADAMVCISNCDKITPGMLMAALRLNIPTVFVSGGPMEAGKVKLGDGEHALDLVDAMVMAADDSVSEEDIELVERSACPTCGSCSGMFTANSMNCLTEALGLSLPGNGSVLATHSDRQNLFKRAGHLIVDLAKRYYEGDDESVLPRSVATYDAFENAMTLDISMGGSTNTVLHLLAAAHEAGVDFTMQDIDQLSRRVPVLCKVAPAKNDVHMEDVHRAGGIMGILGELDRAGLLKTDVSTVHAPSMSAALNEWDVVRNENHHEFYRAAPGGIPTVFAFSQSRRYRELDTDREAGVIRSAEHAFSQDGGLAVLYGNLAEDGCIVKTAGVDESILKFSGPARVFESQDASVDAILSGEVKEGEVVLIRYEGPRGGPGMQEMLYPTSYLKSKGLGKACALVTDGRFSGGSSGLSIGHVSPEAAEGGTIGLVETGDLIEIDIPNRTIHLAVPDAELAARRQKREEEGWHPAEPRPRKITAALRAYASMTTSASRGAVRNI

SEQ ID NO: 509 - DNA, 1680 bp, Wolinella succinogenes
atgagaagtagcatcattaaagaggggtatcaaaaggcgccacaccgaagcttgctgagggcaacggggctcaaagacgaggattttggtaagccattcattggcgtggccaacagctatattgacatcattccgggtcactttttcttgcaagagtatggccgaatcattaaagaggagattagggccgcgggcggaatcccttttgagtttaacactatcggggtggatgatggaatcgccatggggcatgatggaatgctctatagtttgcccagtcgagagctgattgctgattgtattgagacggtgatgaatgcccataaactggacgccatgatctgtatccctaattgcgacaagattgtccctgggatgcttctgggggcactcagagtgaatgtgcccacggtgtttgtgagtggcggaccgatgaaggcaggtcgcctcaaggatggcaccaaagtggatttggcgagtgcttttgaggcggtgggtaaacgcgcgaggaatcagattagcgatgaagagctccgcgagattgagtgcgccgcctgtccggggggaggaagctgcagtggaatgttcacggcgaactccatgaacacactctgtgaagcgatgggagtggcgcttcccgggaatgggacgattccagccctcaccaaagagcgtgaggagctcatccgaaaagccgcaagaagaatcgtagaaatcgcactagatgagcgctacgccttccgcaatattctcaacaaagaggcgattcacaatgcttttgttgtggatatggcgatggggggaagcaccaataccgtacttcatatgatggccattgccaaagagagagaggcggattttgatttgcgcaaaatcaatgagatcgccaaagaggtgagtcatatcgccaaaatctcccctgcactctacactgtccacatggaagacatcaatagagccgggggcgtgaatgcggtcatgaatgagatcaatcgccgaggcggagtgctcaagacagaggcgctcaccgtgagtggcgagagcatgggtgagaggatcgcgggggcgaagattttagatacgcaaatcattcacacgcttgagaatccctatagcgcggtggggggattgaagattctttatggaaatcttgccgagcagggcgctgtgctcaagaccgctgccatggacgctaagatgagaaaattcactggaaaggcagtctgctttgattctcaagaggaggcgatcgcaggtattgtcgggggcaaggtcaaagagggggatgtggtggtgatccgctacgaaggacccaaggggggaccgggaatgcaggagatgctaagtcccacaagcctcatcatggggatgaatttaggagacaaagtcgcgctcattaccgatggccgtttcagcggcgccacgcgtggcgcttgcatcgggcatgtgagtcccgaagcggccgaagggggaatgatcggactgcttcaagagggcgatcttattcgaatcgatgtcgaagaaggggttttggaggtgttgcttgaggaggcggagatccaaaagcgacgcgcctcctttagtcctaaaactaaaaccgttgcctccaagtggctcaaacgctaccagcttctcgtgagcaatgccgcttcaggcgctattttgaaaacggagctataa

SEQ ID NO: 510 - protein, 559 aa, Wolinella succinogenes
MRSSIIKEGYQKAPHRSLLRATGLKDEDFGKPFIGVANSYIDIIPGHFFLQEYGRIIKEEIRAAGGIPFEFNTIGVDDGIAMGHDGMLYSLPSRELIADCIETVMNAHKLDAMICIPNCDKIVPGMLLGALRVNVPTVFVSGGPMKAGRLKDGTKVDLASAFEAVGKRARNQISDEELREIECAACPGGGSCSGMFTANSMNTLCEAMGVALPGNGTIPALTKEREELIRKAARRIVEIALDERYAFRNILNKEAIHNAFVVDMAMGGSTNTVLHMMAIAKEREADFDLRKINEIAKEVSHIAKISPALYTVHMEDINRAGGVNAVMNEINRRGGVLKTEALTVSGESMGERIAGAKILDTQIIHTLENPYSAVGGLKILYGNLAEQGAVLKTAAMDAKMRKFTGKAVCFDSQEEAIAGIVGGKVKEGDVVVIRYEGPKGGPGMQEMLSPTSLIMGMNLGDKVALITDGRFSGATRGACIGHVSPEAAEGGMIGLLQEGDLIRIDVEEGVLEVLLEEAEIQKRRASFSPKTKTVASKWLKRYQLLVSNAASGAILKTEL

SEQ ID NO: 511 - DNA, 1857 bp, Zymomonas mobilis
atgcctccctatcgttccagaaccacgactcatggtcgtaatatggcgggtgccagaagtttatggcgcgcaaccggcgtcaaaaatgaagattttggtaagccgattatcgctgttgccaacagctttacgcaatttgtccccggtcatgtccatttaaaggatatgggacagcttgttgctgaagaaattgaaaaagctggcggtatcgccaaagaattcaatacgattgcgattgatgatggtatcgcgatgggacatggcgggatgctttattccttgccgtctcgggaattgattgccgattccgtcgaatatatggtcaacgcccattgtgctgatgctttggtctgtatttccaactgcgacaagattacgcctggtatgttgatggcttcgatgcgcctgaatatcccgacagttttcgtctctggtggacctatggaagccggtaaagccgaggtcaaaggcgtcaagcgggcgcttgatctgatcgatgctatggtgattgctgccgatgaccattacagcgatggtgaagtcgaagttatcgagcagacggcttgcgctacctgcggttcctgttccggtatgtttacggccaattcgatgaattgcctgaccgaggccttggggctttctttcccaggtaatggttcgatgcttgcgacccatagcgatcgggaacagcttttccgcaaggctgggcataccattgttgatatggcgcgcagctattatgagcaggatgatgccgctgtattaccgcgttcaattgccacgcttgaggcttttgaaaatgcgatgagtcttgatatcgccatgggtggttccaccaatacggttttgcatctgttggcggtcgcgcaggaaggcaacgtgcctttcactatggcggatattgatcgtctttcccgtcatgtcccttgcttatgcaaggtcgcaccggccaaaaatgatgtccatatggaagatgttcatcgggcagggggcgttatggccattttaggccagcttgatcgtgccggattgatcaataccagcttgcgcaccattcattctccgactttaggcgcagcattggacgcatgggatatcagccgtgacagttgttctgaagaagcgcagttattctatcgcgcggctccggggggtgttccgactcaaaaggctttcagccagtcttctcgctatgaagcgctggatactgaccgcgaaaaaggtgtgattcgttctaaaaatcatgctttttcgacggatggtggtctggccgtcttatttggcaatcttgctcctgaaggcagtattgtcaaaactgccggtgtggatgagtctattctgaaattcaccggtaaagccaaggtttacgaaagtcaggaagccgccgttgccggtattcttggcaatgatgtcgaagctggtgaagtggtgatcgttcgctatgaaggtcccaaaggtggccccggtatgcaggaaatgctgtatccgaccagctatctgaaatcgaaaggtttgggtaaactctgcgctctgattaccgatggtcgtttttctggtggtagctctggtttatccatcggccatgtttctcctgaagcggccgagggcggcttgatcgctttggtcgaaaccggtgatacaattgttatcgatattcctgaacggattatccatctggatgttgatgatgctgttattgccgatcgtcatgcccgcatggaagccaagggggcggcagcatggaaaccgcaaaaccgtaatcgtccgatttcttcggctttgaaagcctatgcagctttgacgacaaacgctgcccgtggggcagttcgagatgtcaatcagctcgaacggcgttaa

SEQ ID NO: 512 - protein, 618 aa, Zymomonas mobilis
MPPYRSRTTTHGRNMAGARSLWRATGVKNEDFGKPIIAVANSFTQFVPGHVHLKDMGQLVAEEIEKAGGIAKEFNTIAIDDGIAMGHGGMLYSLPSRELIADSVEYMVNAHCADALVCISNCDKITPGMLMASMRLNIPTVFVSGGPMEAGKAEVKGVKRALDLIDAMVIAADDHYSDGEVEVIEQTACATCGSCSGMFTANSMNCLTEALGLSFPGNGSMLATHSDREQLFRKAGHTIVDMARSYYEQDDAAVLPRSIATLEAFENAMSLDIAMGGSTNTVLHLLAVAQEGNVPFTMADIDRLSRHVPCLCKVAPAKNDVHMEDVHRAGGVMAILGQLDRAGLINTSLRTIHSPTLGAALDAWDISRDSCSEEAQLFYRAAPGGVPTQKAFSQSSRYEALDTDREKGVIRSKNHAFSTDGGLAVLFGNLAPEGSIVKTAGVDESILKFTGKAKVYESQEAAVAGILGNDVEAGEVVIVRYEGPKGGPGMQEMLYPTSYLKSKGLGKLCALITDGRFSGGSSGLSIGHVSPEAAEGGLIALVETGDTIVIDIPERIIHLDVDDAVIADRHARMEAKGAAAWKPQNRNRPISSALKAYAALTTNAARGAVRDVNQLERR

SEQ ID NO: 513 - DNA, 1659 bp, Clostridium acetobutylicum
gtgaattctgataaggcaatgaaaggagtagaaagagctccccacagatctctttttaaggctttaggttttatagatgaggaaatggatagacctcttataggaatagctaattcttacagcgaacttataccaggtcatatgaatcttgataaaatagttaaggctgtaaaagatggaataagaatggcaggaggtgttcctgtagaatttggaaccattggagtttgtgatggtatttctatgaatcataagggaatgagttattctcttccatcaagacagattatagcagatagtgttgagatcgtggctaaagcacatgctcttgatgggcttgtacttgtgccaaattgcgataaggtagttccaggaatgcttatggcggctggaagagttaacataccttcaatagtaataagtggaggaccaatgctttctggtagaacaaatggaagggtcacagatctaaactctgtattcgaagcagttggagcagtttcagcgggaaaaatgtctttagaagaattagctgagcttgagaatacggcatgccctacttgtgggtcttgttctggaatgtttacagcaaattcaatgaactgtctttctgaggttttaggtcttgcgcttccttacaatggaactataccagctgtattttcagaaagattaagacttgctaaaaaggcaggtatgaaaatagttgaattggttcaaaaggacataagaccaagtgacatacttacagaagctgcatttatgaatgcagtcgcaatggatatggcactagggggttctactaattcacttcttcatttaccagctatagcttatgaatgtgacgtggatattaatttcgataaaataaatgagataagtgaaaagattccgcatgtgtgtaagttaagtcctgcaggatttcatcacatagaggacttgcatatggcaggtggaataccggctgttgttaatggaattataaaaaaaggacttctaaatggagagtgtatgacagttacaggtaaaactttgtatgagaatgtgaaggatgcgaaaatcaaaaacattgatgtaataagaatagataatccttatagtgagacaggtggactttcagtattgagaggaaatttagctccagatggcgctatagttaaaaaggcagcagtagcacccgaaatgatgcagcatactggtccggctagggtatttaatagtgaagaggaagtttctaaggcaatacttggtggaaaaataaatccaggtgatgttgttgtgataaggtatgagggccctaagggtggaccaggaatgaaggaaatgctttcgccaacagcttcacttgcaggaatgggacttgataagagtgtggcgcttataactgatggaagattctcaggtgctacaagaggagcatccattggacatgtatctccagaagcggcagaaggtggtccaatagggttggttgaagagggagacacaattgaaatagatattgaaaagaaaactataaacctacttgttccggaagaaaaattaaaaaacagaaaaccggaaaaggttgaaaaacctgtgaagggatatttaaatacgtataggcagggggtatcatctgcttgtacaggagcagtttttcatagtacaaaggagtga

SEQ ID NO: 514 - protein, 552 aa, Clostridium acetobutylicum
MNSDKAMKGVERAPHRSLFKALGFIDEEMDRPLIGIANSYSELIPGHMNLDKIVKAVKDGIRMAGGVPVEFGTIGVCDGISMNHKGMSYSLPSRQIIADSVEIVAKAHALDGLVLVPNCDKVVPGMLMAAGRVNIPSIVISGGPMLSGRTNGRVTDLNSVFEAVGAVSAGKMSLEELAELENTACPTCGSCSGMFTANSMNCLSEVLGLALPYNGTIPAVFSERLRLAKKAGMKIVELVQKDIRPSDILTEAAFMNAVAMDMALGGSTNSLLHLPAIAYECDVDINFDKINEISEKIPHVCKLSPAGFHHIEDLHMAGGIPAVVNGIIKKGLLNGECMTVTGKTLYENVKDAKIKNIDVIRIDNPYSETGGLSVLRGNLAPDGAIVKKAAVAPEMMQHTGPARVFNSEEEVSKAILGGKINPGDVVVIRYEGPKGGPGMKEMLSPTASLAGMGLDKSVALITDGRFSGATRGASIGHVSPEAAEGGPIGLVEEGDTIEIDIEKKTINLLVPEEKLKNRKPEKVEKPVKGYLNTYRQGVSSACTGAVFHSTKE

SEQ ID NO: 515 - DNA, 1671 bp, Clostridium beijerinckii
atgagaagtgatgtaataacaaaaggatctaaaagtgcacctcaacgttcattgcttagtgccttaggtttaacaaaagaagaaatggaaaggcctcttgtaggtatcgtgagctcacaaaatgatatcgttcctggtcatatgaatttagacaaaatagttgaagctgtaaaaatgggagtttcaatggctggaggtactccaattgtctttcctgcaattgctgtttgtgacggtattgctatggggcatgaaggaatgaaatattcattagttacaagagatttaattgcagattctactgaagctatggcaatggctcatgcctttgatgcattagtaatggttcctaattgtgataaaaatgttcctggccttctaatggctgcagcaagagttaatattcctacaatttttgtaagtggcggaccaatgcttgccggaaaagttgacggatgtaagacaagcttatcaagtatgtttgaagctgttggcgcttacaatgctggaaaaattacagctgaaaaattagatgaatatgaaaacaacgtatgccctacttgtggttcttgttcaggaatgtatactgcaaatagtatgaactgtttaacggaagtacttggtatgggccttcaagggaatggtacaatccctgcagtttattcagaaagaataaaacttgcaaagcatgctggcatgaaaatcatggaattacttgaaaagaacataagaccaagagatattatgacagaagatgcatttatgaatgctatgactatggacatggctcttggctgtagtaccaatagtatgttgcatttacctgcaattgcacacgaagttggctttgatttaaatgttgatatagctaatgaaattagttcaaaaacaccgaatctttgccatcttgctcctgctggacacacttatattgaagatttaaatgatgctggtggaatttatgctgttatgaatgaaataaataagcttggtttattaaaaactaaccttataacatgtacaggaaaaactgttggtgaaaacattgaaggatgcataaataaaaatcctgaagttattagaccagtcaaaaatccatatagtcaaactggtgggattgcagttcttaaaggaaatctagcacctgattcatgtgtcgttaagcgttcagccgttgtaccaaaaatgttaaagcatgaaggtccagctaaagtgtttgattgcgaagaagatgcccttgaagcaataaatacaggaaaaattgttgctggagatgttgttgttatcagatatgaaggacctaaaggaggccctggcatgagagaaatgcttaatccaacttctgcaattgcaggaagaggtcttggaagttccgttgctcttataacagatggacgttttagtggcgctagcagaggtgcttcaatcgggcacgtttctccagaggcggcagtaggtggtaacatagcattagttgaggatggagatatgatccaaattgatattaacgctaacactattaacttcttagttagcgatgaagaattagcaagaagaaaagcaaattggaaaccaagaaaaccaaaaataactacaggttatctagcaagatacgctgctcttgttacatcaggaaatagaggtgctatcctagacatccctaaattttaa

SEQ ID NO: 516 - protein, 556 aa, Clostridium beijerinckii
MRSDVITKGSKSAPQRSLLSALGLTKEEMERPLVGIVSSQNDIVPGHMNLDKIVEAVKMGVSMAGGTPIVFPAIAVCDGIAMGHEGMKYSLVTRDLIADSTEAMAMAHAFDALVMVPNCDKNVPGLLMAAARVNIPTIFVSGGPMLAGKVDGCKTSLSSMFEAVGAYNAGKITAEKLDEYENNVCPTCGSCSGMYTANSMNCLTEVLGMGLQGNGTIPAVYSERIKLAKHAGMKIMELLEKNIRPRDIMTEDAFMNAMTMDMALGCSTNSMLHLPAIAHEVGFDLNVDIANEISSKTPNLCHLAPAGHTYIEDLNDAGGIYAVMNEINKLGLLKTNLITCTGKTVGENIEGCINKNPEVIRPVKNPYSQTGGIAVLKGNLAPDSCVVKRSAVVPKMLKHEGPAKVFDCEEDALEAINTGKIVAGDVVVIRYEGPKGGPGMREMLNPTSAIAGRGLGSSVALITDGRFSGASRGASIGHVSPEAAVGGNIALVEDGDMIQIDINANTINFLVSDEELARRKANWKPRKPKITTGYLARYAALVTSGNRGAILDIPKF

SEQ ID NO: 517 - DNA, 1842 bp, Pseudomonas fluorescens
atgcctgattaccgctcgaaaacatccacccatggccgcaacatggccggcgcccgcgccctgtggcgcgccacggggatgaaagatgacgacttcaagaagccgatcatcgccattgccaactccttcacccagttcgtcccggggcacgtgcacctgaaggacctgggccagctggtggctcgcgagatcgaacgcgccggtggcgtggccaaggaattcaacaccatcgccgtggacgacggcatcgccatgggccatgacggcatgctgtattcgctgccgagccgcgagatcatcgccgactccgtggagtacatggtcaacgcccactgtgccgacgccatcgtgtgcatttccaactgcgacaagatcacccccggcatgctgatggccgccctgcgcctgaacatcccggtgatcttcgtttccggcggcccgatggaagccggcaagaccaagctcgccagccatggcctggacctggtggacgccatggtcatcgccgccgactccagcgcttctgacgagaaggttgccgagtacgagcgcagcgcctgcccgacctgcggttcatgctccggcatgttcaccgccaactccatgaactgcctgaccgaagccctggggctcgccctgccgggcaacggttcgaccctggccacccacagcgatcgcgaagagctgttcctgcgggccgggcgcaccatcgtcgagctgtgccagcgctactacggcgacaacgacgagtcggtcctgccgcgcaacatcgccaacttcaaggcgttcgagaacgccatgaccctggatatcgccatgggcggttccaccaacaccatcctgcacctgctggccgccgcccaggaagccgagatcgacttcgacctgcgggacatcgatcgcctgtcgcgccacgtgccgcagctgtgcaaagtggcgccgaacatccagaagtaccacatggaagacgtgcaccgcgccggcggtatcttcagcatcctcggcgaactggcccgtggcggcctgctgcacaccgacctgcccaccgtgcacagcaagaccatggccgaaggcatcgcccagtgggacatcacccagaccagcgacgaagccgtgcatcacttcttcaaggccggcccggcgggcatcccgacccagacggcgttcagccagtcgacccgttgggacagcctcgacgatgaccgtgaaaacggctgcatccgcagtgtcgagcatgcctactcgaaagaaggcggcctggccgtgctctacggcaacatcgccctggacggctgcgtggtgaagaccgccggtgtcgacgagtcgatccatgtcttcgaaggcaacgccaagatcttcgagagccaggacagcgcggtgcgcggcatcctcgccgacgaggtgaaggaaggcgacatcgtgatcatccgttacgaaggcccgaaaggcggcccgggcatgcaggaaatgctctatccgacctcctacctgaagtccaagggcctgggcaaagcctgcgccctgctcaccgacggccgcttctccggcggcacctcgggcctgtccatcggccacgcctcgcctgaagcggcagccggtggcaccatcggcctggtgcaggacggcgacaaggtactgatcgacattcccaaccgctcgatcaacctgttggtcagcgacgaggaactggcggcccgccgtgtcgagcaggacaagaaaggctggaaaccggtggaagcacgcccgcgcaaggtgaccaccgcgctgaaggcctacgccctgctagccaccagcgccgacaagggtgcggtgcgcaacaaggccatgctcgacggcctgtga

SEQ ID NO: 518 - protein, 613 aa, Pseudomonas fluorescens
MPDYRSKTSTHGRNMAGARALWRATGMKDDDFKKPIIAIANSFTQFVPGHVHLKDLGQLVAREIERAGGVAKEFNTIAVDDGIAMGHDGMLYSLPSREIIADSVEYMVNAHCADAIVCISNCDKITPGMLMAALRLNIPVIFVSGGPMEAGKTKLASHGLDLVDAMVIAADSSASDEKVAEYERSACPTCGSCSGMFTANSMNCLTEALGLALPGNGSTLATHSDREELFLRAGRTIVELCQRYYGDNDESVLPRNIANFKAFENAMTLDIAMGGSTNTILHLLAAAQEAEIDFDLRDIDRLSRHVPQLCKVAPNIQKYHMEDVHRAGGIFSILGELARGGLLHTDLPTVHSKTMAEGIAQWDITQTSDEAVHHFFKAGPAGIPTQTAFSQSTRWDSLDDDRENGCIRSVEHAYSKEGGLAVLYGNIALDGCVVKTAGVDESIHVFEGNAKIFESQDSAVRGILADEVKEGDIVIIRYEGPKGGPGMQEMLYPTSYLKSKGLGKACALLTDGRFSGGTSGLSIGHASPEAAAGGTIGLVQDGDKVLIDIPNRSINLLVSDEELAARRVEQDKKGWKPVEARPRKVTTALKAYALLATSADKGAVRNKAMLDGL

SEQ ID NO: 519 - DNA, 1653 bp, Methanococcus maripaludis
atgataagtgataacgtcaaaaaaggagttataagatctccaaaccgagctcttttaaaagcttgcggatattcagacgaagacatggaaaaaccatttattggtgttgtaaacagcttcacagaagttgttcctggccacattcacttaaaaacattatcagaagcagttaaacatggtgtttatgcaaacggcggaacgccatttgaatttaatacaattggaatttgcgacggtattgcaatgggtcatgaaggtatgaaatactccttaccttcaagagaaatcattgcagatgctgttgaatcaatggcaagagcacacggttttgatggccttgttttaattcctacgtgtgataaaatcgttcctggaatgataatgggtgctttaagattaaatattccatttatcgtagttactgggggaccaatgcttccaggcgaattccaaggtaaaaaatgcgaacttattagtctttttgaaggggttggtgagtatcaggttggaaaaattactgaagaagaattaaaaagtattgaagaatgtgcgtgcccgggtgctggaagctgtgcagggctttacactgcaaacagtatggcatgccttacagaagctctcggactatctcttccaatgtgtgcaacaatacatgcggttgatgctcaaaaggttagaatcgctaaaaaaactggctctaaaattgttgacttggtaaaagaagatgtaaaaccaacagatatattgacaaaggaagcttttgaaaacgctattttagttgaccttgcacttggtggatcgacaaatacaacattacacattcctgcaattgcaaatgaaattgaaaataaattcataactctcgatgactttgatagattgagcaacgaagttccacacattgcatcaatcaaacccggtggagaacactacatgattgacctccataatgcaggaggtattcctgcagtattaaatgttttaaagggaaaaattagagatacaaaaacggttgacggaagaagtactttagaaattgcagaatctgtcaaatacataaattacgacgttataagaaaagtagaagctccagttcacgaaactgccggtttgagagttttaaaaggaaatcttgctccaaacggttgcgttgtaaaaatcggtgcagtaaatccaaaaatgtacaaacacgatggacctgcaaaagtttacaattcagaagatgaagcaatttctgcgatactcggtggaaaaattgtagaaggcgacgttatagtaattagatacgaaggaccatcaggtggcccgggaatgagagaaatgctctccccaacttcagcaatctgtggaatgggtcttgatgacagcgttgcattaattactgacggaagattcagtgggggaagcagaggtccatgtataggccacgtttctccagaagctgctgctggcggagtaattgctgcaattgaaaacggagatatcatcaaaattgacatgattggaaaagaaataaatgttgatttggatgaatcagtaattaaagaaagactttcaaaattggatgaatttgagcctaaaatcaaaaaaggctatttatcaagatattcaaggctcgtttcttcagctgatgaaggagcggttttaaaataa

SEQ ID NO: 520 - protein, 550 aa, Methanococcus maripaludis
MISDNVKKGVIRSPNRALLKACGYSDEDMEKPFIGVVNSFTEVVPGHIHLKTLSEAVKHGVYANGGTPFEFNTIGICDGIAMGHEGMKYSLPSREIIADAVESMARAHGFDGLVLIPTCDKIVPGMIMGALRLNIPFIVVTGGPMLPGEFQGKKCELISLFEGVGEYQVGKITEEELKSIEECACPGAGSCAGLYTANSMACLTEALGLSLPMCATIHAVDAQKVRIAKKTGSKIVDLVKEDVKPTDILTKEAFENAILVDLALGGSTNTTLHIPAIANEIENKFITLDDFDRLSNEVPHIASIKPGGEHYMIDLHNAGGIPAVLNVLKGKIRDTKTVDGRSTLEIAESVKYINYDVIRKVEAPVHETAGLRVLKGNLAPNGCVVKIGAVNPKMYKHDGPAKVYNSEDEAISAILGGKIVEGDVIVIRYEGPSGGPGMREMLSPTSAICGMGLDDSVALITDGRFSGGSRGPCIGHVSPEAAAGGVIAAIENGDIIKIDMIGKEINVDLDESVIKERLSKLDEFEPKIKKGYLSRYSRLVSSADEGAVLK

SEQ ID NO: 521 - DNA, 1653 bp, Methanococcus aeolicus
atgataagtgataacttaaagaagggagtttccagagctccaaacagaagtttattaaaggcatgcggatatacggacgaagaaatagaaaaaccattcataggtatagtaaatagctttacagaagtagttcccgggcatattcatttaaatacattggcagaagctgcaaaaaagggagtttatgcaaacggcggaacaccttttgaatttaacactatggccgtatgtgatggtatagctatgggacatgagggaatgagatattcattaccatcaagagagataatagctgatacagtagaaagtatggcgaaagctcatggatttgatggattggtgcttattccgtcctgtgataaaattgttcctggtatgattatgggggctctaagattaaatattccattcatagtaataactggcggacctatgcaacctggggagctccacggtaaaaagtatgaccttataagtgtgtttgaaggagttggagaatataatgttggaaaaattacaaaagaggaattaatggaaattgaaacctgtgcctgtccgggagctggtagctgtgctggattatttacggcaaatagtatggcctgtttaaccgaaacacttggtttatcccttcctatgtgtgctactacacatgcaacagatgccgaaaaggtgagaattgcaaaaagaagcggtatgaaaatagttgatttggtaaaagaagatataaaaccaacagatttattaacaaaggaatcatttgaaaatgcaatattggttgatttggctttgggaggttcttcaaatacaacacttcatattccagctttggcttatgaaatagcaccagagtttataactcttgacgattttgataggttatgcgacgaggtgccacatattgcttcattaaggccggggggagaccactttataagcgatttgcatagggcaggaggtattccagctgttttaaaaatattggagcaaaaaataagggatgctaacactgtaagcggtaaatctattaaagagataataaatgaggtaaaatacattgattataatataattagaccagtggataaaccagtgcatgagaccgcaggattaaggatattaaaaggaaatatagcacctgatggctgtgttgtaaaaattagtgctgtaaatccaaagatgtataaacacgaggggcctgcacgggtatttaattcagaggaggaaaccattgacgcaatacttgggggggacattaaagaaggagatgttgttgtaataagatatgaaggtccagcaggaggtccgggaatgagagaaatgttgtctccaacttctgctatttgtggtatgggattagatgactctgttgcacttattacagatggtagatttagtgggggaagtagaggtccatgtattggacatatctcaccagaggcaatggcaggaggtccaatagccataattgaagaaggagatataattgctattgatatgatggcaaaagaaataaacttaaaaataagcgaagaagagataaaagaaagattagctaattggaaaaaaccagaaataaaagttaaaaaaggatatatatcaagatatgctaaattagtatcttcggcaaatgaaggggcagtattgaaataa

SEQ ID NO: 522 - protein, 550 aa, Methanococcus aeolicus
MISDNLKKGVSRAPNRSLLKACGYTDEEIEKPFIGIVNSFTEVVPGHIHLNTLAEAAKKGVYANGGTPFEFNTMAVCDGIAMGHEGMRYSLPSREIIADTVESMAKAHGFDGLVLIPSCDKIVPGMIMGALRLNIPFIVITGGPMQPGELHGKKYDLISVFEGVGEYNVGKITKEELMEIETCACPGAGSCAGLFTANSMACLTETLGLSLPMCATTHATDAEKVRIAKRSGMKIVDLVKEDIKPTDLLTKESFENAILVDLALGGSSNTTLHIPALAYEIAPEFITLDDFDRLCDEVPHIASLRPGGDHFISDLHRAGGIPAVLKILEQKIRDANTVSGKSIKEIINEVKYIDYNIIRPVDKPVHETAGLRILKGNIAPDGCVVKISAVNPKMYKHEGPARVFNSEEETIDAILGGDIKEGDVVVIRYEGPAGGPGMREMLSPTSAICGMGLDDSVALITDGRFSGGSRGPCIGHISPEAMAGGPIAIIEEGDIIAIDMMAKEINLKISEEEIKERLANWKKPEIKVKKGYISRYAKLVSSANEGAVLK

SEQ ID NO: 523 - DNA, 1842 bp, Vibrio fisheri
atgccaacttatcgttcagccaccaccactcacggacgtaacatggccggagcacgcgctttatggcgtgcaactggcgttaaagaagatgactttggtaaacccatcattgctgttgttaactcatttactcaatttgttccgggtcacgtacatcttaaagacatgggacaacttgttgctggcgaaatagaaaaagccggcggtatcgccaaagagtttaatactatcgccgttgatgatggtatcgctatgggtcacggtggcatgctttattctctgccatcacgcgaactcattgcagactctgttgaatacatggttaatgctcactgtgctgatgctatggtatgtatttctaactgcgacaaaattaccccaggaatgatgatggctgcaatgcgtcttaacattccagtaatttttgtgtcaggcggcccaatggaagcaggaaaaactaagctttcagatcaaataatcaaactggatcttgttgatgcaatgatccaaggtgccgatcctacggtttccgatgctcaaagtgagcagatcgagcgttcagcttgtccaacttgtggatcgtgttcaggaatgttcacggctaactcaatgaactgtttaaccgaagcgctcggtttatctcaaccaggtaatggctcaatgctcgctactcacgccgaccgcgagcagctgtttattaatgcaggtaaacgtattgttgaattaacaaagcgttattatgagcaagatgatgaatcagcacttccaagaaatattgccgaccgtgctgcatttgaaaatgccatggcacttgatatcgcaatgggtggttctagtaataccgttcttcaccttttagcttctgctcaagaaggcgaaattgatttcgatatgggtgacattgatgagatgtctcgtcgagtacctcacttgtgtaaagtcgctccatcaacgcctaaatatcatatggaagatgttcaccgagcaggtggtgtaatggctatccttggtgagttagatagagctgggcttctgaataatcaaacaaaaacggttcttggcttaaccatgcaagagcaacttgcacaatacgatattatgcaaactgaagacgaagagatccttaaattcttccgtgcaggacctgcagggatccgaacaacaaaagcattctcgcaagattgccgttgggatcgccttgatgacgaccgaaaagaagggtgtattcgaaccaaagaaaatgcctttagccaagaaggtggtctcgccgttctatctggcaatatagcggttgatggttgtattgtaaaaaccgccggcgttgatgaagaaaatctaaagttccaaggtccagccattgtttttgaaagccaagactcagcggtagaaggcattttaggtggaaaagttaaagcgggtgaagtcgttgttattcgctacgaaggtccaaagggtggtccaggtatgcaagaaatgctttacccaaccacttacttgaaatcaatgggcttaggcaaagcatgtgcgcttctaactgatggtcgattctctggtggtacatcaggcctatctataggtcacgcatctccagaagctgcaagtggtggcacaataggtttagttaacgatggtgatatcattaccatcgatatcccaagccgctcaattacgcttgatgtaccagaatcagaactgcaagctcgtcgagcgaaacaagatgaactcggttggaaacctgtgaatcgtcaacgtgaagtctcttttgcattaaaagcctatgcaagtatggcaacaagtgcagataaaggtgctgttcgtgataaatctaagttagaagggtaa

SEQ ID NO: 524 - protein, 613 aa, Vibrio fisheri
MPTYRSATTTHGRNMAGARALWRATGVKEDDFGKPIIAVVNSFTQFVPGHVHLKDMGQLVAGEIEKAGGIAKEFNTIAVDDGIAMGHGGMLYSLPSRELIADSVEYMVNAHCADAMVCISNCDKITPGMMMAAMRLNIPVIFVSGGPMEAGKTKLSDQIIKLDLVDAMIQGADPTVSDAQSEQIERSACPTCGSCSGMFTANSMNCLTEALGLSQPGNGSMLATHADREQLFINAGKRIVELTKRYYEQDDESALPRNIADRAAFENAMALDIAMGGSSNTVLHLLASAQEGEIDFDMGDIDEMSRRVPHLCKVAPSTPKYHMEDVHRAGGVMAILGELDRAGLLNNQTKTVLGLTMQEQLAQYDIMQTEDEEILKFFRAGPAGIRTTKAFSQDCRWDRLDDDRKEGCIRTKENAFSQEGGLAVLSGNIAVDGCIVKTAGVDEENLKFQGPAIVFESQDSAVEGILGGKVKAGEVVVIRYEGPKGGPGMQEMLYPTTYLKSMGLGKACALLTDGRFSGGTSGLSIGHASPEAASGGTIGLVNDGDIITIDIPSRSITLDVPESELQARRAKQDELGWKPVNRQREVSFALKAYASMATSADKGAVRDKSKLEG

SEQ ID NO: 525 - DNA, 1860 bp, Shewanella oneidensis
atgccaaagttacgatcagctaccagtacggaaggccgcaatatggcgggtgcccgtgcgctatggcgcgccaccggggtgaaagacaatgattttggtaagccgattattgcgattgccaactcctttactcagtttgttcccggccatgtgcacttaaaagatatgggctcactggtggcgagtgcgattgaagaggcgggcggtatcgccaaagaattcaatactatcgccgtcgacgatggtatcgccatgggccacggtggcatgctctacagtttgccctcgcgggagctgattgccgatagtgtggagtacatggtcaatgcccactgcgccgatgccttagtgtgtatctccaactgcgacaaaatcactcccggcatgttgatggcggcgctgcgtctcaatattcccgtggtatttgtgtcgggtgggccgatggaagcgggtaaaaccaaactgtcggacaaacttatcaagctcgatttagtcgatgccatggtggcggcggccgactcgagtgtgagcgatgaagatagcgccaaaatcgagcgcagtgcttgcccgacgtgtggttcctgttcgggcatgttcaccgccaactctatgaactgtttgaccgaagccctggggttatcgctgccgggcaacggctccatgctggcaacccatagcgatcgccgcgagctgtttttagaggcgggccggcgcgtgatggcgctgaccaagcgttattacgagcaagatgacacctcggcgctgccgcgtaatatcgcctgctttaaagcttttgagaacgccaccgcattagatatcgccatgggcggttcgtctaatactgtgttgcacttgttagcggcggcgcaggaggcggaagtcgcatttactatggacgatatcgaccgtatgtcgcgccttgtgccgcacctttgtaaagtcgccccatcgacgcctaaatatcatatggaagatgtgcaccgcgccggtggcgtgatgggcattttaggcgagcttgaccgcgccggattgctgcataccgatgtgccacacgttgccgccgatgcaggcggaaatctcaagtcggtgcttgccaagtacgatgtcatgcaaacccaagatgacaacgtaaaacaattctttatggcgggacctgcgggcatccccaccactaaagcctttagtcaagactgccgctggccatcgctggatgatgacaggcgagaagggtgtatccgcagccgcgaatttgcctttagccaagaaggcgggctggccgtgctgtcgggcaatttagctgaaaatggctgtattgttaaaacggcgggcgtggatgagtcgaatttgatttttgttggctcggctcgcgtctacgaaagccaagatgatgcggtggcgggcattttaggtggcgaagtagtggcgggcgatgtggtcgtcatccgttacgaagggccaaaaggtggtccgggtatgcaagaaatgttgtaccccaccagttacttaaaatcccgcggcttaggcaaggcctgcgcgctaatcaccgatggacgtttctctggtggaacatccggtttatccatcggccatgtgtcgcccgaggcggcggctggcggcacgattgccttgattgaaaacggcgatcgcattgaaatcgatatcccagcgcgcagtattaagctcgctgtgagcgatgccgagttagcggggcgtcgtgagaccatgttagcgcgtggtccaatggcgtggaagcctgttggtcgcgagcgttttgtatctatggcactaaaagcctacgccatgcttgccaccagtgccgataagggcgcggtgcgcgatcgcagcaagttggaggactga

SEQ ID NO: 526 - protein, 619 aa, Shewanella oneidensis
MPKLRSATSTEGRNMAGARALWRATGVKDNDFGKPIIAIANSFTQFVPGHVHLKDMGSLVASAIEEAGGIAKEFNTIAVDDGIAMGHGGMLYSLPSRELIADSVEYMVNAHCADALVCISNCDKITPGMLMAALRLNIPVVFVSGGPMEAGKTKLSDKLIKLDLVDAMVAAADSSVSDEDSAKIERSACPTCGSCSGMFTANSMNCLTEALGLSLPGNGSMLATHSDRRELFLEAGRRVMALTKRYYEQDDTSALPRNIACFKAFENATALDIAMGGSSNTVLHLLAAAQEAEVAFTMDDIDRMSRLVPHLCKVAPSTPKYHMEDVHRAGGVMGILGELDRAGLLHTDVPHVAADAGGNLKSVLAKYDVMQTQDDNVKQFFMAGPAGIPTTKAFSQDCRWPSLDDDRREGCIRSREFAFSQEGGLAVLSGNLAENGCIVKTAGVDESNLIFVGSARVYESQDDAVAGILGGEVVAGDVVVIRYEGPKGGPGMQEMLYPTSYLKSRGLGKACALITDGRFSGGTSGLSIGHVSPEAAAGGTIALIENGDRIEIDIPARSIKLAVSDAELAGRRETMLARGPMAWKPVGRERFVSMALKAYAMLATSADKGAVRDRSKLED

SEQ ID NO: 527 - DNA, 1716 bp, Artificial Sequence
  K564E
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttgggagcctgaagaaactggcaaaaaatga

SEQ ID NO: 528 - protein, 571 aa, Artificial Sequence
  K564E
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWEPEETGKK

SEQ ID NO: 529 - DNA, 1716 bp, Artificial Sequence
  D257 R407
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgatattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgccgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttgggagcctgaagaaactggcaaaaaatga

SEQ ID NO: 530 - DNA, 1716 bp, Artificial Sequence
  G368
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggacaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttgggagcctgaagaaactggcaaaaaatga

SEQ ID NO: 531 - DNA, 1716 bp, Artificial Sequence
  D62E F562V
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgagtttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacgtttggaagcctgaagaaactggcaaaaaatga

SEQ ID NO: 532 - protein, 571 aa, Artificial Sequence
  D62E F562V
MTDKKTLKDLRNRSSVYDSMVKSPNRAMLRATGMQDEDFEKPIVGVISTWAENTPCNIHLHEFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDVWKPEETGKK

SEQ ID NO: 533 - DNA, 1716 bp, Artificial Sequence
  G33D W563R
atgactgacaaaaaaactcttaaagacttaagaaatcgtagttctgtttacgattcaatggttaaatcacctaatcgtgctatgttgcgtgcaactgatatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagactttcggaagcctgaagaaactggcaaaaaatga

SEQ ID NO: 534 - protein, 571 aa, Artificial Sequence
  G33D W563R
MTDKKTLKDLRNRSSVYDSMVKSPNRAMLRATDMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFRKPEETGKK

SEQ ID NO: 535 - DNA, 1716 bp, Artificial Sequence
  G218 K314 G557
atgactgacaaaaaaactcttaaagacttaagaaatcgtagttctgtttacgattcaatggttaaatcacctaatcgtgctatgttgcgtgcaactgatatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttggggcttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaagccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggtgccgtaacagactttcggaagcctgaagaaactggcaaaaaatga

SEQ ID NO: 536 - DNA, 1716 bp, Artificial Sequence
  F562V
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacgtttggaagcctgaagaaactggcaaaaaatga

SEQ ID NO: 537 - protein, 571 aa, Artificial Sequence
  F562V
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDVWKPEETGKK

SEQ ID NO: 538 - DNA, 1716 bp, Artificial Sequence
  G199
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctgggggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacgtttggaagcctgaagaaactggcaaaaaatga

SEQ ID NO: 539 - DNA, 1716 bp, Artificial Sequence
  W563R
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagactttaggaagcctgaagaaactggcaaaaaatga

SEQ ID NO: 540 - protein, 571 aa, Artificial Sequence
  W563R
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFRKPEETGKK

SEQ ID NO: 541 - DNA, 1716 bp, Artificial Sequence
  L343
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttcctccatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagactttaggaagcctgaagaaactggcaaaaaatga

SEQ ID NO: 542 - DNA, 1716 bp, Artificial Sequence
  G93 I155 D511
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggtacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaatcgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgatcaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagactttaggaagcctgaagaaactggcaaaaaatga

SEQ ID NO: 543 - DNA, 1716 bp, Artificial Sequence
  R13 V486
atgactgacaaaaaaactcttaaagacttaagaaatcgcagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtaggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagactttaggaagcctgaagaaactggcaaaaaatga

SEQ ID NO: 544 - DNA, 1716 bp, Artificial Sequence
  W563C
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttgtaagcctgaagaaactggcaaaaaatga

SEQ ID NO: 545 - protein, 571 aa, Artificial Sequence
  W563C
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFCKPEETGKK

SEQ ID NO: 546 - DNA, 1715 bp, Artificial Sequence
  G70 D395
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggagttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagatggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttgtaagcctgaagaaactggcaaaaaatg

SEQ ID NO: 547 - DNA, 1716 bp, Artificial Sequence
  E524G W563G
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatggagagttaaaacatcgtcaagagaccattgaattgccaccgctctattcacgcggtatccttggtaaatatgctcacatcgtttcgtctgcttctaggggagccgtaacagactttgggaagcctgaagaaactggcaaaaaatga

SEQ ID NO: 548 - protein, 571 aa, Artificial Sequence
  E524G W563G
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDGELKHRQETIELPPLYSRGILGKYAHIVSSASRGAVTDFGKPEETGKK

SEQ ID NO: 549 - DNA, 1716 bp, Artificial Sequence
  L253 A397
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttgaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgcagttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatggagagttaaaacatcgtcaagagaccattgaattgccaccgctctattcacgcggtatccttggtaaatatgctcacatcgtttcgtctgcttctaggggagccgtaacagactttgggaagcctgaagaaactggcaaaaaatga

SEQ ID NO: 550 - DNA, 1716 bp, Artificial Sequence
  A397
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgcagttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatggagagttaaaacatcgtcaagagaccattgaattgccaccgctctattcacgcggtatccttggtaaatatgctcacatcgtttcgtctgcttctaggggagccgtaacagactttgggaagcctgaagaaactggcaaaaaatga

SEQ ID NO: 551 - DNA, 1716 bp, Artificial Sequence
  M115V G158R E567D
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccgtgggaggtcataatgcggatgcttttgtagccattggcggttgtgataaaaacatgcccggttctgttatcgctatggctaacatggatatcccagccatttttgcttacggcggaacaattgcacctcgtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagatactggcaaaaaatga

SEQ ID NO: 552 - protein, 571 aa, Artificial Sequence
  M115V G158R E567D
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAVGGHNADAFVAIGGCDKNMPGSVIAMANMDIPAIFAYGGTIAPRNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEDTGKK

SEQ ID NO: 553 - DNA, 1716 bp, Artificial Sequence
  T49 P308
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacatgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccgtgggaggtcataatgcggatgcttttgtagccattggcggttgtgataaaaacatgcccggttctgttatcgctatggctaacatggatatcccagccatttttgcttacggcggaacaattgcacctcgtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttccacatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagatactggcaaaaaatga

SEQ ID NO: 554 - DNA, 1716 bp, Artificial Sequence
  G116E N119S
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatggaaggtcatagtgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 555 - protein, 571 aa, Artificial Sequence
  G116E N119S
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMEGHSADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 556 - DNA, 1716 bp, Artificial Sequence
  G33D
atgactgacaaaaaaactcttaaagacttaagaaatcgtagttctgtttacgattcaatggttaaatcacctaatcgtgctatgttgcgtgcaactgatatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 557 - protein, 571 aa, Artificial Sequence
  G33D
MTDKKTLKDLRNRSSVYDSMVKSPNRAMLRATDMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 558 - DNA, 1716 bp, Artificial Sequence
  G218
atgactgacaaaaaaactcttaaagacttaagaaatcgtagttctgtttacgattcaatggttaaatcacctaatcgtgctatgttgcgtgcaactgatatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttggggcttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 559 - DNA, 1716 bp, Artificial Sequence
  G218 K314 G557
atgactgacaaaaaaactcttaaagacttaagaaatcgtagttctgtttacgattcaatggttaaatcacctaatcgtgctatgttgcgtgcaactgatatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttggggcttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaagccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggtgccgtaacagacttttggaagcctgaagaaactggcaaaaaatga

SEQ ID NO: 560 - DNA, 1716 bp, Artificial Sequence
  D62E
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgagtttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 561 - protein, 571 aa, Artificial Sequence
  D62E
MTDKKTLKDLRNRSSVYDSMVKSPNRAMLRATGMQDEDFEKPIVGVISTWAENTPCNIHLHEFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 562 - DNA, 1716 bp, Artificial Sequence
  F562L
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttatggaagcctgaagaaactggcaaaaaatga

SEQ ID NO: 563 - protein, 571 aa, Artificial Sequence
  F562L
MTDKKTLKDLRNRSSVYDSMVKSPNRAMLRATGMQDEDFEKPIVGVISTWAENTPCNIHLHEFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDLWKPEETGKK

SEQ ID NO: 564 - DNA, 1716 bp, Artificial Sequence
  P134
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcctggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttatggaagcctgaagaaactggcaaaaaatga

SEQ ID NO: 565 - DNA, 1716 bp, Artificial Sequence
  H176Q H179L Q322R W563R
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccagtggaacctcggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccgagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagactttaggaagcctgaagaaactggcaaaaaatga

SEQ ID NO: 566 - protein, 571 aa, Artificial Sequence
  H176Q H179L Q322R W563R
MTDKKTLKDLRNRSSVYDSMVKSPNRAMLRATGMQDEDFEKPIVGVISTWAENTPCNIHLHEFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGQWNLGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFRDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDLRKPEETGKK

SEQ ID NO: 567 - DNA, 1716 bp, Artificial Sequence
  Q369 V436
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccagtggaacctcggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccgagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcagaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgtagttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagactttaggaagcctgaagaaactggcaaaaaatga

SEQ ID NO: 568 - DNA, 1716 bp, Artificial Sequence
  A425S W563R
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaatctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagactttaggaagcctgaagaaactggcaaaaaatga

SEQ ID NO: 569 - protein, 571 aa, Artificial Sequence
  A425S W563R
MTDKKTLKDLRNRSSVYDSMVKSPNRAMLRATGMQDEDFEKPIVGVISTWAENTPCNIHLHEFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIESVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDLRKPEETGKK

SEQ ID NO: 570 - DNA, 1716 bp, Artificial Sequence
  A490
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaatctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgcacctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagactttaggaagcctgaagaaactggcaaaaaatga

SEQ ID NO: 571 - DNA, 1716 bp, Artificial Sequence
  W563G
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagactttgggaagcctgaagaaactggcaaaaaatga

SEQ ID NO: 572 - protein, 571 aa, Artificial Sequence
  W563G
MTDKKTLKDLRNRSSVYDSMVKSPNRAMLRATGMQDEDFEKPIVGVISTWAENTPCNIHLHEFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDLGKPEETGKK

SEQ ID NO: 573 - DNA, 1716 bp, Artificial Sequence
  P228
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccagctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 574 - DNA, 1716 bp, Artificial Sequence
  G93 I155 D511
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggtacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaatcgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgatcaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 575 - DNA, 75 bp, Artificial Sequence
  Leu2
ggccggctcttactttctaacttttcttaccttttacatttcagcaatatatatatatatactagtcacgtgagt

SEQ ID NO: 576 - DNA, 74 bp, Artificial Sequence
  truncated FBA promoter
tcttccttgcgttattcttctgttcttctttttcttttgtcatatataaccataaccaagtaatacatattcaa

SEQ ID NO: 577 - DNA, 9613 bp, Artificial Sequence
  pHR81 Ilv5p-K9G9
ggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcgaaggagtggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggc

SEQ ID NO: 578 - DNA, 10948 bp, Artificial Sequence
  pRS423 FBAp-IlvD(sm) GPMp-ADH
ccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgcctggcggcactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtcacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatctctagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaatcggaccgtcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcgccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgg

SEQ ID NO: 579 - DNA, 9638 bp, Artificial Sequence
  pRS423 Leu2p(75)-IlvD(Sm) GPMp-ADH sequence
atacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggctcttactttctaacttttcttaccttttacatttcagcaatatatatatatatactagtcacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatctctagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaatcggaccgtcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcgccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcac

SEQ ID NO: 580 - DNA, 20 bp, Artificial Sequence
  Primer N98SeqF1
cgtgttagtcacatcaggac

SEQ ID NO: 581 - DNA, 22 bp, Artificial Sequence
  N99SeqR2
catcgactgcattacgcaactc

SEQ ID NO: 582 - DNA, 4306 bp, Artificial Sequence
  Clone B pUC19-URA3 ilvD-TRX1
tatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttt

SEQ ID NO: 583 - DNA, 20 bp, Artificial Sequence
  N98SeqF4
ggtttctgtctctggtgacg

SEQ ID NO: 584 - DNA, 30 bp, Artificial Sequence
  N1111
tatttgtatcgaggtgtctagtcttctatt

SEQ ID NO: 585 - DNA, 30 bp, Artificial Sequence
  N1110
gcgatttaatctctaattattagttaaagt

SEQ ID NO: 586 - DNA, 1772 bp, Artificial Sequence
  chimeric construct
cctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatct

SEQ ID NO: 587 - DNA, 1854 bp, Artificial Sequence
  Synthetic construct-HincII-KpnI fragment
gactctagaggatcccccaccttggctaactcgttgtatcatcactggataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgataacttcgtatagcatacattatacgaagttatctgaacattagaatacgtaatccgcaatgcgg

SEQ ID NO: 588 - DNA, 38 bp, Artificial Sequence
  BK468
gcctcgagttttaatgttacttctcttgcagttaggga

SEQ ID NO: 589 - DNA, 22 bp, Artificial Sequence
  N160SeqF5
cctgaagtctaggtccctattt

SEQ ID NO: 590 - DNA, 7589 bp, Artificial Sequence
  pUC19-kan pdc1 FBA-alsS TRX1 (clone A)
tatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaaggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagctctagatttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcagatcttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccgactctagaggatcccccaccttggctaactcgttgtatcatcactggataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgataacttcgtatagcatacattatacgaagttatctgaacattagaatacgtaatccgcaatgcggggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttt

SEQ ID NO: 591 - DNA, 22 bp, Artificial Sequence
  oBP512
aaagttggcatagcggaaactt

SEQ ID NO: 592 - DNA, 11856 bp, Artificial Sequence
  pYZ090
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 593 - DNA, 38 bp, Artificial Sequence
  N191 primer
atccgcggatagatctcccattaccgacatttgggcgc

SEQ ID NO: 594 - DNA, 9593 bp, Artificial Sequence
  pYZ090 alsS
ggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactag

SEQ ID NO: 595 - DNA, 15539 bp, Artificial Sequence
  pLH468
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 596 - DNA, 22 bp, Artificial Sequence
  primer oBP556
tattttcgaggaccttgtcacc

SEQ ID NO: 597 - DNA, 25 bp, Artificial Sequence
  primer oBP561
tggccattaatctttcccatattag

SEQ ID NO: 598 - DNA, 12896 bp, Artificial Sequence
  pBP915
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 599 - DNA, 1485 bp, Vibrio cholerae
atggctaactattttaacactctgaatctgcgcgaacagctggatcagctgggtcgttgtcgcttcatggcgcgcgaggaattcgcaactgaagcggactacctgaagggtaagaaagtggtcatcgtaggctgtggcgcgcagggcctgaaccagggtctgaatatgcgtgatagcggcctggacgtgtcttacgcactgcgtcaagcggccatcgatgaacagcgtcagtctttcaaaaatgctaagaacaacggtttcaatgtaggttcttacgaacagctgattccgacggcggacctggttatcaatctgaccccggataaacagcacaccagcgtggttaacgcggttatgccgctgatgaaacagggcgctgctctgggctatagccatggttttaacatcgtggaagagggcatgcagattcgtaaagacatcacggtagtaatggtggcgccgaaatgcccaggtactgaggttcgtgaggaatacaagcgtggttttggcgttcctaccctgattgcagtgcacccggaaaacgatccgcagggcgaaggttgggaaatcgctaaggcatgggctgcagccactggtggccaccgcgctggttgcctggcctctagcttcgtcgcagaagtaaaaagcgacctgatgggcgaacagaccatcctgtgtggtatgctgcaggccggtagcatcgtttgctacgaaaagatggttgctgatggtatcgacccgggctacgcgggcaaactgctgcagtttggttgggaaactattaccgaggctctgaaattcggtggcatcacccacatgatggaccgtctgagcaacccggcaaagatcaaagcattcgaactgtctgaagagctgaaagacctgatgcgtccgctgtacaacaagcacatggacgacattatttccggccacttttcttctaccatgatggcggactgggccaacgacgacaaggatctgttcggctggcgtgcggagaccgctgaaaccgcatttgaaaactatccgaccactgacgttaagatcgcggagcaggaatactttgacaacggtatcctgatgattgcaatggttcgcgcgggcgttgaactggcgtttgaagcgatgaccgcttctggtatcatcgatgaatctgcatactatgagtccctgcacgagctgccgctgatcgctaacacggtggcccgcaaacgtctgtatgaaatgaatgtcgtaatctctgacacggctgaatatggtaattatctgttcgccaatgtggcagttcctctgctgcgtgagaaattcatgccgaaagtgggtaccgatgttattggtaaaggtctgggtgtcgtttctaaccaggtagataacgcgactctgatcgaagtgaactccatcatccgtaaccacccggtggaatacattggtgaagaactgcgtggttatatgaaggacatgaagcgtatcgccgttggtgattaa

SEQ ID NO: 600 - protein, 494 aa, Vibrio cholerae
MANYFNTLNLREQLDQLGRCRFMAREEFATEADYLKGKKVVIVGCGAQGLNQGLNMRDSGLDVSYALRQAAIDEQRQSFKNAKNNGFNVGSYEQLIPTADLVINLTPDKQHTSVVNAVMPLMKQGAALGYSHGFNIVEEGMQIRKDITVVMVAPKCPGTEVREEYKRGFGVPTLIAVHPENDPQGEGWEIAKAWAAATGGHRAGCLASSFVAEVKSDLMGEQTILCGMLQAGSIVCYEKMVADGIDPGYAGKLLQFGWETITEALKFGGITHMMDRLSNPAKIKAFELSEELKDLMRPLYNKHMDDIISGHFSSTMMADWANDDKDLFGWRAETAETAFENYPTTDVKIAEQEYFDNGILMIAMVRAGVELAFEAMTASGIIDESAYYESLHELPLIANTVARKRLYEMNVVISDTAEYGNYLFANVAVPLLREKFMPKVGTDVIGKGLGVVSNQVDNATLIEVNSIIRNHPVEYIGEELRGYMKDMKRIAVGD

SEQ ID NO: 601 - DNA, 1014 bp, Psuedonomas aeruginosa PAO1
atgcgcgttttctacgataaagactgtgacctctcgatcatccagggcaagaaagttgccatcatcggctacggctcccagggccacgcccatgcctgcaacctgaaggactccggcgtcgacgtcaccgtgggcctgcgtagcggctccgccaccgtggccaaggccgaagcgcacggtctgaaggttgccgacgtgaagaccgccgtcgccgcagccgacgtggtcatgatcctcaccccggacgagttccagggccgcctgtacaaggaagagatcgagccgaacctgaagaagggcgccaccctggccttcgctcacggcttctccatccactacaaccaggtcgtcccgcgcgccgacctcgacgtgatcatgatcgcgccgaaggcaccgggtcacaccgtgcgttccgagttcgtcaagggcggtggcatccctgacctgatcgccatctaccaggacgcttccggcaacgccaagaacgtcgccctgtcctacgcctgcggcgtcggcggcggtcgtaccggtatcatcgaaaccaccttcaaggacgagaccgaaaccgacctgttcggtgagcaggccgttctctgcggtggttgcgtcgagctggtcaaggccggtttcgaaaccctggtcgaagccggttacgcgccggaaatggcctacttcgagtgcctgcacgagctgaagctgatcgtcgacctgatgtacgaaggcggcatcgccaacatgaactactccatctccaacaatgccgaatacggtgagtacgtaaccggtccggaggtgatcaacgccgagtcccgtgctgccatgcgcaacgccctgaagcgcatccaggacggcgagtacgcgaaaatgttcattaccgaaggtgcggccaactacccgtcgatgactgcctaccgccgcaacaacgccgctcacccgatcgagcagatcggcgagaagctgcgcgcgatgatgccgtggatcgcagccaacaagatcgtcgacaagagcaagaac

SEQ ID NO: 602 - protein, 338 aa, Psuedonomas aeruginosa
MRVFYDKDCDLSIIQGKKVAIIGYGSQGHAHACNLKDSGVDVTVGLRSGSATVAKAEAHGLKVADVKTAVAAADVVMILTPDEFQGRLYKEEIEPNLKKGATLAFAHGFSIHYNQVVPRADLDVIMIAPKAPGHTVRSEFVKGGGIPDLIAIYQDASGNAKNVALSYACGVGGGRTGIIETTFKDETETDLFGEQAVLCGGCVELVKAGFETLVEAGYAPEMAYFECLHELKLIVDLMYEGGIANMNYSISNNAEYGEYVTGPEVINAESRAAMRNALKRIQDGEYAKMFITEGAANYPSMTAYRRNNAAHPIEQIGEKLRAMMPWIAANKIVDKSKN

SEQ ID NO: 603 - DNA, 1014 bp, Pseudonomas fluorescens
atgaaagttttctacgataaagactgcgacctgtcgatcatccaaggtaagaaagttgccatcatcggctacggttcccagggccacgctcaagcatgcaacctgaaggattccggcgtagacgtgactgttggcctgcgtaaaggctcggctaccgttgccaaggctgaagcccacggcttgaaagtgaccgacgttgctgcagccgttgccggtgccgacttggtcatgatcctgaccccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggtggtattcctgacctgatcgcgatctaccaggacgcttccggcaacgccaagaacgttgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaac

SEQ ID NO: 604 - protein, 338 aa, Pseudomonas fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 605 - protein, 343 aa, Anaerostipes caccae
MEECKMAKIYYQEDCNLSLLDGKTIAVIGYGSQGHAHALNAKESGCNVIIGLYEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 606 - DNA, 1716 bp, Artificial Sequence
  W563R Isolate 101
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagactttcggaagcctgaagaaactggcaaaaaatga

What is claimed is:

1. An isolated polypeptide having dihydroxy-acid dehydratase (DHAD) activity, wherein the polypeptide is a *Streptococcus mutans* DHAD and comprises one or more amino acid substitutions selected from:
   (a) aspartic acid at a position corresponding to position 33 of SEQ ID NO: 168;
   (b) glutamic acid at a position corresponding to position 62 of SEQ ID NO: 168;
   (c) valine at a position corresponding to position 115 of SEQ ID NO: 168;
   (d) glutamic acid at a position corresponding to position 116 of SEQ ID NO: 168;
   (e) serine at a position corresponding to position 119 of SEQ ID NO: 168;
   (f) arginine at a position corresponding to position 158 of SEQ ID NO: 168;
   (g) glutamine at a position corresponding to position 176 of SEQ ID NO: 168;
   (h) leucine at a position corresponding to position 179 of SEQ ID NO: 168;
   (i) arginine at a position corresponding to position 322 of SEQ ID NO: 168;
   (j) serine at a position corresponding to position 425 of SEQ ID NO: 168;
   (k) glycine at a position corresponding to position 524 of SEQ ID NO: 168;
   (l) valine or leucine at a position corresponding to position 562 of SEQ ID NO: 168;
   (m) arginine, cysteine, or glycine at a position corresponding to position 563 of SEQ ID NO: 168;
   (n) glutamic acid at a position corresponding to position 564 of SEQ ID NO: 168; and
   (o) aspartic acid at a position corresponding to position 567 of SEQ ID NO: 168.

2. The isolated polypeptide of claim 1, wherein the polypeptide comprises one or more amino acid substitutions selected from:
   (a) glycine to aspartic acid at a position corresponding to position 33 of SEQ ID NO: 168;
   (b) aspartic acid to glutamic acid at a position corresponding to position 62 of SEQ ID NO: 168;
   (c) methionine to valine at a position corresponding to position 115 of SEQ ID NO: 168;
   (d) glycine to glutamic acid at a position corresponding to position 116 of SEQ ID NO: 168;
   (e) asparagine to serine at a position corresponding to position 119 of SEQ ID NO: 168;
   (f) glycine to arginine at a position corresponding to position 158 of SEQ ID NO: 168;
   (g) histidine to glutamine at a position corresponding to position 176 of SEQ ID NO: 168;
   (h) histidine to leucine at a position corresponding to position 179 of SEQ ID NO: 168;
   (i) glutamine to arginine at a position corresponding to position 322 of SEQ ID NO: 168;
   (j) alanine to serine at a position corresponding to position 425 of SEQ ID NO: 168;
   (k) glutamic acid to glycine at a position corresponding to position 524 of SEQ ID NO: 168;
   (l) phenylalanine to valine or leucine at a position corresponding to position 562 of SEQ ID NO: 168;
   (m) tryptophan to arginine, cysteine, or glycine at a position corresponding to position 563 of SEQ ID NO: 168;
   (n) lysine to glutamic acid at a position corresponding to position 564 of SEQ ID NO: 168; and
   (o) glutamic acid to aspartic acid at a position corresponding to position 567 of SEQ ID NO: 168.

3. The isolated polypeptide of claim 1, wherein the polypeptide having DHAD activity comprises three conserved cysteines corresponding to positions 56, 129, and 201 of SEQ ID NO: 168.

4. A method of converting 2,3-dihydroxyisovalerate to α-ketoisovalerate or 2,3-dihydroxymethylvalerate to α-ketomethylvalerate, comprising providing the isolated polypeptide of claim 1; wherein the isolated polypeptide catalyzes the conversion of 2,3-dihydroxyisovalerate to α-ketoisovalerate or 2,3-dihydroxymethylvalerate to α-ketomethylvalerate.

5. The method of claim 4, wherein the isolated polypeptide is comprised within a recombinant host cell.

6. The isolated polypeptide of claim 1, wherein the polypeptide is selected from SEQ ID NO: 528, 532, 534, 537, 540, 545, 548, 552, 555, 557, 561, 563, 566, 569, and 572.

* * * * *